(12) United States Patent
Kim et al.

(10) Patent No.: US 12,546,779 B2
(45) Date of Patent: Feb. 10, 2026

(54) BINDING MOLECULE HAVING NEUTRALIZING ACTIVITY AGAINST SARS-CORONAVIRUS-2

(71) Applicants: CELLTRION INC., Yeonsu-gu Incheon (KR); KOREA DISEASE CONTROL AND PREVENTION AGENCY, Chungcheongbuk-do (KR)

(72) Inventors: Cheol-Min Kim, Yeonsu-gu Incheon (KR); Ji-Min Seo, Yeonsu-gu Incheon (KR); Min-Soo Kim, Yeonsu-gu Incheon (KR); Soo-Young Lee, Yeonsu-gu Incheon (KR); Dong-Kyun Ryu, Yeonsu-gu Incheon (KR); Sung-Soon Kim, Chungcheongbuk-do (KR); Joo-Yeon Lee, Chungcheongbuk-do (KR); Kyung-Chang Kim, Chungcheongbuk-do (KR); Jeong-Sun Yang, Chungcheongbuk-do (KR); Han-Saem Lee, Chungcheongbuk-do (KR); Hye-Min Woo, Chungcheongbuk-do (KR); Jun-Won Kim, Chungcheongbuk-do (KR)

(73) Assignees: CELLTRION, INC. (KR); KOREA DISEASE CONTROL AND PREVENTION AGENCY (KR)

( * ) Notice: Subject to any disclaimer, the term of this patent is extended or adjusted under 35 U.S.C. 154(b) by 812 days.

(21) Appl. No.: 17/913,182

(22) PCT Filed: Mar. 22, 2021

(86) PCT No.: PCT/KR2021/003498
§ 371 (c)(1),
(2) Date: Sep. 21, 2022

(87) PCT Pub. No.: WO2021/194188
PCT Pub. Date: Sep. 30, 2021

(65) Prior Publication Data
US 2023/0113734 A1    Apr. 13, 2023

(30) Foreign Application Priority Data

| | | |
|---|---|---|
| Mar. 22, 2020 | (KR) | 10-2020-0034747 |
| Mar. 23, 2020 | (KR) | 10-2020-0035291 |
| Apr. 10, 2020 | (KR) | 10-2020-0044346 |
| Apr. 29, 2020 | (KR) | 10-2020-0052871 |
| Jul. 3, 2020 | (KR) | 10-2020-0082406 |
| Jul. 16, 2020 | (KR) | 10-2020-0088512 |
| Aug. 20, 2020 | (KR) | 10-2020-0104967 |
| Nov. 13, 2020 | (KR) | 10-2020-0152186 |

(51) Int. Cl.
*C07K 16/10* (2006.01)
*G01N 33/569* (2006.01)
*A61K 39/00* (2006.01)

(52) U.S. Cl.
CPC .... *G01N 33/56983* (2013.01); *C07K 16/1003* (2023.08); *A61K 2039/505* (2013.01); *C07K 2317/21* (2013.01); *C07K 2317/565* (2013.01); *C07K 2317/622* (2013.01); *C07K 2317/76* (2013.01); *C07K 2317/92* (2013.01); *G01N 2333/165* (2013.01); *G01N 2469/10* (2013.01)

(58) Field of Classification Search
CPC ............ C07K 16/1003; C07K 2317/24; A61K 2039/505
See application file for complete search history.

(56) References Cited

U.S. PATENT DOCUMENTS

2006/0240551 A1    10/2006    Jinag et al.

FOREIGN PATENT DOCUMENTS

KR    1020080012449 A    2/2008

OTHER PUBLICATIONS

Tian, X., Li, C., Huang, A., Xia, S., Lu, S., Shi, Z., . . . Ying, T. (2020). Potent binding of 2019 novel coronavirus spike protein by a SARS coronavirus-specific human monoclonal antibody. Emerging Microbes Infections, 9(1), 382-385. (Year: 2020).*
Wang, et al., "A human monoclonal antibody blocking SARS-CoV-2 infection", bioRxiv, Mar. 12, 2020.
Shebley, et al., "Phase 1 study of safety, pharmacokinetics, and antiviral activity of SARS-CoV-2 neutralizing monoclonal antibody ABBV-47D11 in patients with COVID-19", Pharmacology Research & Perspectives, Dec. 20, 2022.
Fedry, et al., "Structural insights into the cross-neutralization of SARS-CoV and SARS-CoV-2 by the human monoclonal antibody 47D11", Science Advances, vol. 7, No. 23, Jun. 2, 2021.
"Regkirona Product Information", Aug. 25, 2023.
Alexandra C. Walls, et al.; entitled "Structure, Function, and Antigenicity of the SARS-CoV-2-Spike Glycoprotein"; Cell 180; vol. 180; Apr. 16, 2020; pp. 281-292; e1-e4; S1-S2; vol. 183, Issue 6, Dec. 10, 2020, p. 1735.
Yushun Wan, et al.; entitled Receptor Recognition by the Novel Coronavirus from Wuhan: an Analysis Based on Decade-Long Structural Studies of SARS Coronavius; Journal of Virology; vol. 94; No. 7; Apr. 2020; pp. 1-9.
Daniel Wrapp, et al.; entitled "Cryo-EM structure of the 2019-nCoV spike in the prefusion conformation"; Science 367; Mar. 13, 2020; pp. 1260-1263.
Rui Shi, et al.; entitled "A human neutralizing antibody targets the receptor-binding site of SARS-CoV-2"; Nature vol. 584; Aug. 6, 2020; pp. 120-124; and supplement.

(Continued)

*Primary Examiner* — Aurora M Fontainhas
*Assistant Examiner* — Jennifer A Benavides
(74) *Attorney, Agent, or Firm* — BakerHostetler

(57) ABSTRACT

The present invention relates to a binding molecule that binds to SARS-coronavirus-2 (SARS-CoV-2). More particularly, the binding molecule of the present invention has strong ability to bind to a spike protein (S protein) on the surface of SARS-coronavirus-2 and high neutralizing activity against SARS-coronavirus-2 and is thus very useful in the diagnosis, prevention or treatment of SARS-coronavirus infection (COVID-19).

10 Claims, 20 Drawing Sheets

Specification includes a Sequence Listing.

(56) References Cited

OTHER PUBLICATIONS

Kevin J. Kramer, et al.; entitled "Potent neutralization of SARS-CoV-2 variants of concern by an antibody with an uncommon genetic signature and structural mode of spike recognition"; Cell Reports 37, 109784; Oct. 5, 2021; pp. 1-12; e1-e9.

Thomas F. Rogers, et al.; entitled "Isolation of potent SARS-CoV-2 neutralizing antibodies and protection from disease in a small animal model"; Science 369, 956-963; Aug. 21, 2020; pp. 1-8.

* cited by examiner

BINDING MOLECULE HAVING NEUTRALIZING ACTIVITY AGAINST SARS-CORONAVIRUS-2

CROSS-REFERENCE TO RELATED APPLICATIONS

This application is a US National Stage of International Patent Application No. PCT/KR2021/003498, filed Mar. 22, 2021, which claims priority to Korean Patent Application No. 10-2020-0034747, filed Mar. 22, 2020, Korean Patent Application No. 10-2020-0035291, filed Mar. 23, 2020, Korean Patent Application No. 10-2020-0044346, filed Apr. 10, 2020, Korean Patent Application No. 10-2020-0052871, filed Apr. 29, 2020, Korean Patent Application No. 10-2020-0082406, filed Jul. 3, 2020, Korean Patent Application No. 10-2020-0088512, filed Jul. 16, 2020, Korean Patent Application No. 10-2020-0104967, filed Aug. 20, 2020, and Korean Patent Application No. 10-2020-0152186, filed Nov. 13, 2020, the entire contents of which are hereby incorporated by reference in their entirety.

REFERENCE TO SEQUENCE LISTING SUBMITTED ELECTRONICALLY

The official copy of the sequence listing is submitted electronically via EFS-Web as an ASCII formatted sequence listing with a file named "FC22187US_Sequence listing.txt", created on Sep. 21, 2022, and having a size of 999 kilobytes and is filed concurrently with the specification. The sequence listing contained in this ASCII formatted document is part of the specification and is herein incorporated by reference in its entirety.

The present invention relates to a binding molecule that binds to severe acute respiratory syndrome-coronavirus-2 (SARS-CoV-2), and more particularly to a binding molecule having strong ability to bind to and to neutralize a spike protein (S protein) on the surface of SARS-coronavirus-2.

BACKGROUND

Severe acute respiratory syndrome-coronavirus-2 (SARS-CoV-2), which is observed to be a positive-sense single-stranded RNA coronavirus when subjected to DNA sequencing, is contagious to humans and is the cause of coronavirus disease 2019 (COVID-19). The first outbreak of COVID-19 occurred in Wuhan City, Hubei Province, China.

People infected with SARS-CoV-2 may exhibit mild to severe symptoms such as fever, cough, shortness of breath, and diarrhea. People with complications or illnesses and the elderly are more likely to die.

In particular, early detection and treatment are very important because people with underlying diseases such as heart disease and diabetes are more susceptible to infection and more likely to suffer from complications or organ damage. From Dec. 8, 2019 to Mar. 20, 2020, there were 245,550 patients, among whom 10,049 died, which is a mortality rate of 4.09% (WHO). The virus spread to 177 countries, including Korea, by 2020.

Currently, there is no therapeutic agent for coronavirus disease 2019 (COVID-19), and therapeutic effects are expected to be exhibited by administering existing therapeutic agents to patients. Ebola therapeutic agents or candidates, for example, antiviral drugs such as favipiravir, remdesivir, and galidesivir, and a hepatitis C drug such as ribavirin, are being used as therapeutic agents for COVID-19. Compared to drugs used for Ebola treatment, ribavirin, which is a hepatitis C drug, may have severe side effects such as anemia, and interferon, which is an antiviral drug, is also recommended to be used with caution because of the various side effects thereof. Chloroquine, which is an anti-malarial drug, has also been shown to be effective against COVID-19 and is in open clinical trials.

Although these drugs have been used in the treatment of COVID-19 patients and show effects thereon, it has not yet been clearly proven on what mechanism they are effective. In China, it was announced that plasma therapy of injecting the plasma of patients who had recovered from COVID-19 is effective in the treatment of severely ill patients, but care should be taken because the therapeutic effect thereof is unclear and the risk is high.

In Korea, the COVID-19 Central Clinical Trial TF (Task Force) established a treatment principle for COVID-19 on Feb. 13, 2020, and announced that Kaletra, which is an AIDS therapeutic agent, and chloroquine and hydroxychloroquine, which are antimalarial drugs, are recommended as the first-line therapeutic agents, and ribavirin and interferon are not recommended due to side effects thereof. As for mild cases or young patients, and 10 days after the onset of the disease, it was judged that the symptoms would improve without administration of an antiviral drug, and it was agreed to administer antiviral drugs to the elderly, patients with underlying diseases, and severely ill patients.

The US CDC announced that i) COVID-19 could become endemic like IERS rather than a seasonal pandemic virus and cause infection, and ii) mentioned the need to strengthen surveillance so that data-based conclusions can be drawn although there is no evidence that the coronavirus is lurking in the real community due to the spread of the virus to the community at some point this year or next year (Feb. 13, 2020).

The Korea Disease Control and Prevention Agency (formerly Korea Centers for Disease Control and Prevention) announced that i) COVID-19 could be a long-term epidemic like influenza and thus it should be included in monitoring programs such as that used for influenza, and ii) coronavirus (4 types) that is prevalent among people also remains unchanged from winter to spring, leaving the possibility that COVID-19 could also become endemic (Feb. 17, 2020).

Unlike SARS and MERS, there are concerns about the realization of the COVID-19 pandemic, but there is the possibility of a lull after spring (April), so there are many experts who take a careful approach depending on the progress thereof. Due to the lack of information on COVID-19, experts have different opinions on future developments, but few experts predict that it will be resolved in a short time. Although further progress of COVID-19 will be influenced by the accuracy of analysis of prevalence and characteristics of COVID-19 and by how long the crisis from COVID-19 will last, there are concerns about the possibility of endemic disease if it is spread worldwide through asymptomatic infected people. There is urgent need to prepare countermeasures for the likelihood of recurrence of COVID-19 worldwide.

A rapid diagnostic test (RDT) is also referred to by various names such as "immunochromatographic analysis", "rapid kit analysis", and the like, and is an analysis method using an immunochromatographic strip including a support, a sample pad, a conjugate pad, a signal detection pad, and an absorption pad, in which the user can simply detect an analyte from a biological or chemical sample within 2 to 30 minutes with 1-100 µl of a sample without special techniques or equipment. A rapid diagnostic test is a method capable of qualitatively and quantitatively testing analytes in a short time using the properties in which biological or chemical materials specifically adhere to each other. For the rapid diagnostic test, an immunochromatographic strip is simply used, or an immunochromatographic kit in which the immunochromatographic strip is provided inside a plastic housing is used. When simply using the immunochromatographic strip, a separate container for the sample is required, but the immunochromatographic kit provided in the housing is easy to use because it does not require a separate experimental container due to direct introduction of the sample into the inlet formed in the housing.

The rapid diagnostic test is the most advanced assay kit among the detection methods developed until recently in view of simplicity and quickness, and is usefully used to diagnose various disease-causing substances such as antibodies or antigens of infectious pathogens, cancer factors, heart markers, and the like.

Through analysis using the immunochromatographic strip or the immunochromatographic kit including the same, using samples such as whole blood, plasma, serum, tears, saliva, urine, rhinorrhea, body fluids and the like of humans or animals, it is possible to quickly test and diagnose the presence or absence of antibodies and pathogens that cause SARS, MERS, Influenza virus, bird flu virus, rotavirus, hepatitis A, hepatitis B, hepatitis C, AIDS, syphilis, *chlamydia*, malaria, typhoid, bacteria causative of gastric ulcers, tuberculosis, dengue fever, leprosy, etc.

There are no prophylactic agents, therapeutic agents or diagnostic kits specific to SARS-CoV-2 yet. Accordingly, the present inventors endeavored to develop antibodies specific to SARS-CoV-2, and continuously studied the development of antibodies having superior binding abilities, neutralizing activities, and diagnostic effects, thus culminating in the present invention.

SUMMARY OF THE INVENTION

In order to solve the above problems, the present inventors developed a binding molecule that is able to bind to coronavirus (CoV), particularly SARS-coronavirus (SARS-CoV), particularly SARS-coronavirus-2 (SARS-CoV-2), particularly the surface of SARS-coronavirus-2 (SARS-CoV-2), particularly a spike protein (S protein) on the surface of SARS-coronavirus-2 (SARS-CoV-2), and ascertained that this binding molecule has strong ability to bind to and/or to neutralize SARS-CoV-2, thereby culminating in the present invention.

An objective of the present invention is to provide a neutralizing binding molecule that binds to a spike protein (S protein) on the surface of SARS-coronavirus-2 (SARS-CoV-2).

In addition, another objective of the present invention is to provide a composition for diagnosing, preventing or treating a coronavirus (CoV)-related disease, particularly SARS-coronavirus infection (COVID-19), including the binding molecule.

In addition, still another objective of the present invention is to provide a kit for diagnosing, preventing or treating a coronavirus (CoV)-related disease, particularly SARS-coronavirus infection (COVID-19).

In addition, yet another objective of the present invention is to provide a method of diagnosing, preventing or treating a coronavirus (CoV)-related disease, particularly a disease caused by SARS-coronavirus infection.

In addition, still yet another objective of the present invention is to provide the use of the binding molecule for the preparation of a composition for diagnosing, preventing or treating a coronavirus (CoV)-related disease, particularly a disease caused by SARS-coronavirus infection.

In addition, a further objective of the present invention is to provide the use of the composition for the diagnosis, prevention or treatment of a disease caused by SARS-coronavirus infection, including administering the composition in a therapeutically effective amount to a subject having a coronavirus (CoV)-related disease, particularly a disease caused by SARS-coronavirus infection (COVID-19).

In addition, still a further objective of the present invention is to provide a method of producing a binding molecule, including introducing a nucleic acid molecule encoding the binding molecule into a host cell, culturing the host cell under conditions that allow expression of the nucleic acid molecule, and selecting the binding molecule from the cultured host cell and/or a culture.

In addition, yet a further objective of the present invention is to provide a binding molecule produced using the method of producing a binding molecule.

Technical Solution

In order to accomplish the above objectives, the present invention provides a binding molecule, particularly a neutralizing binding molecule, which binds to coronavirus (CoV), particularly SARS-coronavirus (SARS-CoV), particularly SARS-coronavirus-2 (SARS-CoV-2), particularly the surface of SARS-coronavirus-2 (SARS-CoV-2), particularly a spike protein (S protein) on the surface of SARS-coronavirus-2 (SARS-CoV-2).

In addition, the present invention provides an immunoconjugate in which at least one tag is additionally bound to the binding molecule.

In addition, the present invention provides a nucleic acid molecule encoding the binding molecule.

In addition, the present invention provides an expression vector into which the nucleic acid molecule is inserted.

In addition, the present invention provides a cell line transformed with the expression vector.

In addition, the present invention provides a composition for diagnosing, preventing or treating SARS-coronavirus infection (COVID-19) including the binding molecule.

In addition, the present invention provides a kit for diagnosing, preventing or treating SARS-coronavirus infection (COVID-19) including the binding molecule.

In addition, the present invention provides a method of diagnosing, preventing or treating a disease caused by SARS-coronavirus infection, including administering the composition in a therapeutically effective amount to a subject having a disease caused by SARS-coronavirus infection (COVID-19).

In addition, the present invention provides a strip for immunochromatographic analysis, including the binding molecule.

In addition, the present invention provides a diagnostic kit for diagnosing SARS-coronavirus infection (COVID-19), including the strip for immunochromatographic analysis.

In addition, the present invention provides a method of detecting SARS-coronavirus-2 (SARS-CoV-2) using the diagnostic kit.

In addition, the present invention provides a method of diagnosing SARS-coronavirus infection (COVID-19) using the diagnostic kit.

In addition, the present invention provides the use of the binding molecule for the preparation of a composition for diagnosing, preventing or treating a disease caused by SARS-coronavirus infection.

In addition, the present invention provides the use of the composition for the diagnosis, prevention or treatment of a disease caused by SARS-coronavirus infection, including administering the composition in a therapeutically effective amount to a subject having a disease caused by SARS-coronavirus infection (COVID-19).

In addition, the present invention provides a method of producing a binding molecule, including introducing a nucleic acid molecule encoding the binding molecule into a host cell, culturing the host cell under conditions that allow expression of the nucleic acid molecule, and selecting the binding molecule from the cultured host cell and/or a culture.

In addition, the present invention provides a binding molecule produced using the method of producing a binding molecule.

Hereinafter, a detailed description will be given of the present invention.

The scope of the present invention is not limited by the following description, and in particular, may include all aspects that may vary depending on the experimental conditions described in the following examples and the like. Since the scope of the present invention is limited by the appended claims, terms used herein for further understanding are used only for the purpose of describing detailed embodiments of the present invention, and the scope of the present invention is not limited thereby.

Unless otherwise defined herein, all technical and scientific terms used in this specification are to be interpreted as having the same meanings as terms generally understood by those of ordinary skill in the art. All of the references mentioned in this specification are incorporated by reference in their entirety into the present specification to describe the invention of the present specification.

The present invention includes a binding molecule having ability to bind to or to neutralize all or part of coronavirus (CoV), particularly SARS-coronavirus (SARS-CoV), particularly SARS-coronavirus-2 (SARS-CoV-2), particularly the surface of SARS-coronavirus-2 (SARS-CoV-2), particularly a spike protein (S protein) on the surface of SARS-coronavirus-2 (SARS-CoV-2), an immunoconjugate in which at least one tag is additionally bound to the binding molecule, a nucleic acid molecule encoding the binding molecule, an expression vector into which the nucleic acid molecule is inserted, and/or a cell line transformed with the expression vector; a composition for diagnosing, preventing or treating coronavirus (CoV) and a kit for diagnosing, preventing or treating coronavirus (CoV), including at least one of the foregoing; a method of diagnosing, preventing or treating coronavirus (CoV) using at least one of the foregoing, the use thereof for the diagnosis, prevention or treatment of coronavirus (CoV), and the use thereof for the preparation of the binding molecule, the immunoconjugate, the nucleic acid molecule, the expression vector, the cell line, the composition or the kit for diagnosing, preventing or treating coronavirus (CoV), but the scope of the present invention is not limited thereto, and all analogues thereof may be included within the scope of the present invention.

The present invention includes, but is not limited to, a binding molecule, particularly a neutralizing binding molecule, which binds to coronavirus (CoV), particularly a spike protein (S protein) on the surface of SARS-coronavirus-2 (SARS-CoV-2). In the present invention, the binding molecule is able to bind to the RBD (receptor-binding domain) of the spike protein on the surface of SARS-coronavirus-2, but is not limited thereto.

The spike protein (S protein) on the surface of SARS-coronavirus-2 (SARS-CoV-2) of the present invention may consist of or comprise the sequence of SEQ ID NO: 2321, and may include, but is not limited to, derivatives and/or variants thereof.

The RBD (receptor-binding domain) of the spike protein on the surface of SARS-coronavirus-2 (SARS-CoV-2) of the present invention may consist of or comprise the sequence of SEQ ID NO: 2322, and may include, but is not limited to, derivatives and/or variants thereof.

The neutralizing binding molecule of the present invention has strong ability to bind to and/or to neutralize all or part of coronavirus (CoV), particularly SARS-coronavirus (SARS-CoV), particularly SARS-coronavirus-2 (SARS-CoV-2), particularly the surface of SARS-coronavirus-2 (SARS-CoV-2), particularly a spike protein (S protein) on the surface of SARS-coronavirus-2 (SARS-CoV-2), but the present invention is not limited thereto. Also, the neutralizing binding molecule of the present invention exhibits high neutralizing activity against a mutant virus having a mutation on the spike protein of SARS-coronavirus-2 (SARS-CoV-2). In an embodiment thereof, the neutralizing binding molecule of the present invention is a binding molecule screened as a binding molecule that is able to bind to the RBD (receptor-binding domain) of the spike protein of SARS-coronavirus-2 (SARS-CoV-2) and to neutralize the same, and may exhibit high neutralizing activity against a mutant virus on the site of the S protein, other than the RBD, but the present invention is not limited thereto.

In the present invention, the coronavirus (CoV) includes any virus of the coronavirus group, and includes SARS-CoV-2, MERS-CoV and SARS-CoV, and may be interpreted with reference to known content related thereto. The SARS-coronavirus-2 (SARS-CoV-2) of the present invention includes viruses that are recognized as 2019-nCoV, Wuhan coronavirus and/or variants thereof, and a series of related viruses derived therefrom.

As for the SARS-coronavirus-2 of the present invention, the World Health Organization (WHO) classifies coronavirus into six types based on amino acid changes due to differences in gene sequence. Coronavirus is first classified into S and L types, and is then further divided into L, V, and G types, and G is subdivided into GH and GR, resulting in a total of six types: S, L, V, G, GH, and GR. At the beginning of the outbreak of COVID-19, S and V types were prevalent in Asian regions including Wuhan, China, and then different types were discovered in each continent, and the SARS-coronavirus-2 of the present invention includes these types. Among these, it has been reported that the GH type is likely to have high transmissibility. In Korea, based on the results of classifying genes collected from patients with coronavirus infection, most of them were found to be GH type, which is a variant of the G type prevalent in Europe and the United States, and this type is known to be highly transmissible. In particular, the G-type virus, in which the No. 614 amino acid of the spike protein, which plays an important role in the intracellular invasion of the virus, is changed from aspartic acid (D) to glycine (G), has increased rapidly in Europe and the United States since March, and now appears in almost all regions, and the SARS-coronavirus-2 of the present invention includes the same. According to a recent report, more than 70 coronavirus mutations were confirmed to have occurred, among which 8 mutations having increased transmissibility (D614G, etc.), 10 mutations avoiding neutralizing antibodies (A841V, etc.), and 17 mutations having low plasma treatment effects (I472V, etc.) were identified, and the SARS-coronavirus-2 of the present invention includes the same.

In an embodiment thereof, the neutralizing binding molecule of the present invention may exhibit neutralizing activity against strains such as an S type (the amino acid at position 614 of the S protein is D), G type (the amino acid at position 614 of the S protein is G), V type, L type, GH type, or GR type, based on the amino acid mutation of SARS-coronavirus-2 (SARS-CoV-2), but the present invention is not limited to these strains. Examples of the SARS-CoV-2 virus S-type include, but are not limited to, a BetaCoV/Korea/KCDC03/2020 strain. Examples of the SARS-CoV-2 virus G-type include, but are not limited to, hCoV-19/South Korea/KUMC17/2020 and hCoV-19/South Korea/KCDC9481/2020 strains. Examples of the SARS-CoV-2 virus V-type include, but are not limited to, an hCoV-19/Korea/KCDC31/2020 strain. Examples of the SARS-CoV-2 virus L-type include, but are not limited to, an hCoV-19/South Korea/KNIH04/2020 strain. Examples of the SARS-CoV-2 virus GH-type include, but are not limited to, an hCoV-19/Korea/KCDC10847/2020 strain. Examples of the SARS-CoV-2 virus GR-type include, but are not limited to, an hCoV-19/South Korea/KUMC17/2020 strain.

In an embodiment thereof, the neutralizing binding molecule of the present invention exhibits high neutralizing activity against a mutant virus having a D614G mutation at amino acid position 614 of the spike protein of SARS-coronavirus-2 (SARS-CoV-2). In an embodiment thereof, the neutralizing binding molecule of the present invention exhibits strong ability to bind to and/or to neutralize mutant proteins A435S, F342L, G476S, K458R, N354D, V367F, V483A, and W436R of the surface protein (RBD) of SARS-coronavirus-2 (SARS-CoV-2).

In an embodiment thereof, the neutralizing binding molecule of the present invention has ability to bind to and/or to neutralize SARS-coronavirus-2 strains isolated to date, for example, the UNKNOWN-LR757996 strain and the SARS-CoV-2/Hu/DP/Kng/19-027 strain, the isolation date and location of which are unknown; Wuhan-Hu-1 strain isolated from China in December 2019; BetaCoV/Wuhan/IPBCAMS-WH-01/2019 strain first isolated from China on Dec. 23, 2019; BetaCoV/Wuhan/IPBCAMS-WH-02/2019 strain, BetaCoV/Wuhan/IPBCAMS-WH-03/2019 strain, BetaCoV/Wuhan/IPBCAMS-WH-04/2019 strain, WIV02 strain, WIV04 strain, WIV05 strain, WIV06 strain, and WIV07 strain isolated from China on Dec. 30, 2019; 2019-nCoV/Japan/TY/WK-521/2020 strain, 2019-nCoV/Japan/TY/WK-501/2020 strain, 2019-nCoV/Japan/TY/WK-012/2020 strain, and 2019-nCoV/Japan/KY/V-029/2020 strain isolated from Japan in January 2020; SNU01 strain isolated from Korea in January 2020; BetaCoV/Korea/KCDC03/2020 strain isolated from Korea; BetaCoV/Wuhan/IPBCAMS-WH-05/2020 strain isolated from China on Jan. 1, 2020; 2019-nCoV WHU02 strain, and 2019-nCoV WHU01 strain isolated from China on Jan. 2, 2020; SARS-CoV-2/WH-09/human/2020/CHN strain isolated from China on Jan. 8, 2020; 2019-nCoV_HKU-SZ-002a_2020 strain isolated from China on Jan. 10, 2020; 2019-nCoV_HKU-SZ-005b_2020 strain isolated from China on Jan. 11, 2020; SARS-CoV-2/Yunnan-01/human/2020/CHN strain isolated from China on Jan. 17, 2020; 2019-nCoV/USA-WA1/2020 strain isolated from the United States on Jan. 19, 2020; HZ-1 strain isolated from China on Jan. 20, 2020; 2019-nCoV/USA-IL1/2020 strain isolated from the United States on Jan. 21, 2020; 2019-nCoV/USA-CA2/2020 strain, and 2019-nCoV/USA-AZ1/2020 strain isolated from the United States on Jan. 22, 2020; 2019-nCoV/USA-CA1/2020 strain isolated from the United States on Jan. 23, 2020; Australia/VICO1/2020 strain isolated from Australia on Jan. 25, 2020; 2019-nCoV/USA-WA1-F6/2020 strain, and 2019-nCoV/USA-WA1-A12/2020 strain isolated from the United States on Jan. 25, 2020; 2019-nCoV/USA-CA6/2020 strain isolated from the United States on Jan. 27, 2020; 2019-nCoV/USA-IL2/2020 strain isolated from the United States on Jan. 28, 2020; 2019-nCoV/USA-MA1/2020 strain, 2019-nCoV/USA-CA5/2020 strain, 2019-nCoV/USA-CA4/2020 strain, and 2019-nCoV/USA-CA3/2020 strain isolated from the United States on Jan. 29, 2020; nCoV-FIN-29 Jan. 2020 strain isolated from Finland on Jan. 29, 2020; SARS-CoV-2/IQTC02/human/2020/CHN strain isolated from China on Jan. 29, 2020; 2019-nCoV/USA-WI1/2020 strain isolated from the United States on Jan. 31, 2020; SARS-CoV-2/NTU01/2020/TWN strain isolated from Taiwan on Jan. 31, 2020; SARS-CoV-2/NTU02/2020/TWN strain isolated from Taiwan on Feb. 5, 2020; 2019-nCoV/USA-CA7/2020 strain isolated from the United States on Feb. 6, 2020; SARS-CoV-2/01/human/2020/SWE strain isolated from Sweden on Feb. 7, 2020; 2019-nCoV/USA-CA8/2020 strain isolated from the United States on Feb. 10, 2020; 2019-nCoV/USA-TX1/2020 strain isolated from the United States on Feb. 11, 2020; 2019-nCoV/USA-CA9/2020 strain isolated from the United States on Feb. 23, 2020; SARS-CoV-2/SP02/human/2020/BRA strain isolated from Brazil on Feb. 28, 2020; UNKNOWN-LR757995, UNKNOWN-LR757997, UNKNOWN-LR757998, and SARS-CoV-2/Hu/DP/Kng/19-020, the isolation date and location of which are unknown; 2019-nCoV/Japan/AI/I-004/2020 isolated from Japan in January 2020; SARSOCoV-2/61-TW/human/2020/NPL isolated from Nepal on Jan. 13, 2020; SARS-CoV-2/IQTC01/human/2020/CHN strain isolated from China on Feb. 5, 2020; hCoV-19/South Korea/KUMC17/2020 strain isolated in Korea and SARS-coronavirus-2 strain to be isolated in the future, and the present invention is not limited to these strains.

Antibody-dependent enhancement (ADE) is well known in dengue virus, and is a phenomenon by which an immune cell is infected by a non-neutralizing antibody, thereby exacerbating a disease. Specifically, it refers to a phenomenon by which the antibody binds to the virus and the virus bound to the antibody infects the immune cell through the interaction between the Fc of the antibody and the FcR of the immune cell. In some of the literature, it was reported that the serum of SARS patients did not neutralize the virus, but rather increased the viral infection of immune cells (Journal of Virology 85: 10582). There was not observed a viral infection enhancement phenomenon, that is, an ADE phenomenon, due to the interaction between the Fc of the neutralizing binding molecule of the present invention and the Fcγ receptor of the immune cell, against SARS-coronavirus-2.

In an embodiment of the present invention, the binding molecule includes any one binding molecule among the binding molecule Nos. 1 to 290 shown in Table 1 below, and includes a binding molecule derived therefrom. For example, for each of the binding molecule Nos. 1 to 290 shown in Table 1 below, a binding molecule that comprises all of three light-chain CDR regions (LC CDR1, LC CDR2, and LC CDR3) and three heavy-chain CDR regions (HC CDR1, HC CDR2, and HC CDR3), or comprises a light-chain CDR region comprising at least one CDR region of three light-chain CDR regions (LC CDR1, LC CDR2, and LC CDR3) and/or a heavy-chain CDR region comprising at least one CDR region of three heavy-chain CDR regions (HC CDR1, HC CDR2, and HC CDR3), and achieves the purposes and effects of the present invention, is included within the scope of the present invention. In Table 1 below, No. means each binding molecule number. In the present invention, the "binding molecule that achieves the purposes and effects of the present invention" may include a binding molecule in which the lowest concentration value for neutralizing the virus of 100 TCID50 for SARS-coronavirus-2 (SARS-CoV-2) is preferably 10 µg/ml or less, more preferably 5 µg/ml or less, more preferably 3.5 µg/ml or less, more preferably 2.5 µg/ml or less, more preferably 2.0 µg/ml or less, and most preferably 3.3 µg/ml or less; and/or
a binding molecule that is able to bind to RBD of the spike protein of SARS-coronavirus-2 at an equilibrium dissociation constant ($K_D$) of preferably $1.0 \times 10^{-8}$ M or less, more preferably $1.0 \times 10^{-9}$ M or less, and most preferably $1.0 \times 10^{-10}$ M or less; and/or
a binding molecule in which the monomer content (%) determined through size exclusion chromatography (SEC-HPLC) is preferably 97% or more, more preferably 98% or more, more preferably 99% or more, and most preferably 99.87%; and/or
a binding molecule in which the purity of intact IgG determined through non-reduced capillary electrophoresis (CE) is preferably 85% or more, more preferably 86% or more, more preferably 87% or more, more preferably 88% or more, and most preferably 89% or more; and/or
a binding molecule in which the sum of heavy and light chains determined through reduced capillary electrophoresis (CE) is preferably 95% or more, more preferably 96% or more, more preferably 97% or more, more preferably 98% or more, and most preferably 99%, but the present invention is not limited thereto.

Also, in another embodiment of the present invention, the binding molecule includes, among the binding molecules shown in Table 1 below, any one binding molecule selected from the group consisting of binding molecule Nos. 1, 2, 3, 4, 6, 7, 8, 9, 13, 14, 31, 44, 46, 47, 48, 49, 53, 55, 56, 65, 66, 69, 70, 71, 72, 79, 81, 83, 86, 88, 89, 90, 91, 93, 95, 103, 108, 113, 118, 128, 129, 139, 152, 195, 196, 197, 201, 203, 204, 205, 206, 207, 208, 209, 212, 213, 214, 215, 216, 217, 218, 219, 220, 221, 224, 230, 232, 235, 236, 239, 241, 242, 243, 244, 245, 246, 247, 249, 250, 251, 252, 254, 256, 259, 260, 261, 263, 265, 266, 268, 270, 271, 274, 275, 276, 278, 279, 280, 281, 283, 284, 285, 287, 288, 289 and 290, or a binding molecule derived therefrom. For each of the above binding molecule numbers, a binding molecule that comprises all of three light-chain CDR regions (LC CDR1, LC CDR2, and LC CDR3) and three heavy-chain CDR regions (HC CDR1, HC CDR2, and HC CDR3), or comprises a light-chain CDR region comprising at least one CDR region of three light-chain CDR regions (LC CDR1, LC CDR2, and LC CDR3) and/or a heavy-chain CDR region comprising at least one CDR region of three heavy-chain CDR regions (HC CDR1, HC CDR2, and HC CDR3), and achieves the purposes and effects of the present invention, is included within the scope of the present invention.

Also, in another embodiment of the present invention, the binding molecule includes, among the binding molecules shown Table 1 below, any one binding molecule selected from the group consisting of binding molecule Nos. 89, 90, 91, 93, 95, 103, 108, 113, 118, 128, 129, 139, 152, 217, 218, 230, 260, 270, 271, 274, 275, 281 and 284, or a binding molecule derived therefrom. For each of the above binding molecule numbers, a binding molecule that comprises all of three light-chain CDR regions (LC CDR1, LC CDR2, and LC CDR3) and three heavy-chain CDR regions (HC CDR1, HC CDR2, and HC CDR3), or comprises a light-chain CDR region comprising at least one CDR region of three light-chain CDR regions (LC CDR1, LC CDR2, and LC CDR3) and/or a heavy-chain CDR region comprising at least one CDR region of three heavy-chain CDR regions (HC CDR1, HC CDR2, and HC CDR3), and achieves the purposes and effects of the present invention, is included within the scope of the present invention.

Also, in another embodiment of the present invention, the binding molecule includes, among the binding molecules shown in Table 1 below, any one binding molecule selected from the group consisting of binding molecule Nos. 91, 93, 103, 129, 139, 217, 260, 270, 275 and 284, or a binding molecule derived therefrom. For each of the above binding molecule numbers, a binding molecule that comprises all of three light-chain CDR regions (LC CDR1, LC CDR2, and LC CDR3) and three heavy-chain CDR regions (HC CDR1, HC CDR2, and HC CDR3), or comprises a light-chain CDR region comprising at least one CDR region of three light-chain CDR regions (LC CDR1, LC CDR2, and LC CDR3) and/or a heavy-chain CDR region comprising at least one CDR region of three heavy-chain CDR regions (HC CDR1, HC CDR2, and HC CDR3), and achieves the purposes and effects of the present invention, is included within the scope of the present invention.

Also, in another embodiment of the present invention, the binding molecule includes, among the binding molecules shown in Table 1 below, any one binding molecule selected from the group consisting of binding molecule Nos. 91, 93, 103, 129, 139 and 260, or a binding molecule derived therefrom. For each of the above binding molecule numbers, a binding molecule that comprises all of three light-chain CDR regions (LC CDR1, LC CDR2, and LC CDR3) and three heavy-chain CDR regions (HC CDR1, HC CDR2, and HC CDR3), or comprises a light-chain CDR region comprising at least one CDR region of three light-chain CDR regions (LC CDR1, LC CDR2, and LC CDR3) and/or a heavy-chain CDR region comprising at least one CDR region of three heavy-chain CDR regions (HC CDR1, HC CDR2, and HC CDR3), and achieves the purposes and effects of the present invention, is included within the scope of the present invention.

Also, in another embodiment of the present invention, the binding molecule includes, among the binding molecules shown in Table 1 below, any one binding molecule selected from the group consisting of binding molecule Nos. 91, 93, 103, 129 and 139, or a binding molecule derived therefrom. For each of the above binding molecule numbers, a binding molecule that comprises all of three light-chain CDR regions (LC CDR1, LC CDR2, and LC CDR3) and three heavy-chain CDR regions (HC CDR1, HC CDR2, and HC CDR3), or comprises a light-chain CDR region comprising at least one CDR region of three light-chain CDR regions (LC CDR1, LC CDR2, and LC CDR3) and/or a heavy-chain CDR region comprising at least one CDR region of three heavy-chain CDR regions (HC CDR1, HC CDR2, and HC CDR3), and achieves the purposes and effects of the present invention, is included within the scope of the present invention.

Also, in another embodiment of the present invention, the binding molecule may be a binding molecule of No. 139 among the binding molecules shown in Table 1 below, or a binding molecule derived therefrom. For the binding molecule No. 139, a binding molecule that comprises all of three light-chain CDR regions (LC CDR1, LC CDR2, and LC CDR3) and three heavy-chain CDR regions (HC CDR1, HC CDR2, and HC CDR3), or comprises a light-chain CDR region comprising at least one CDR region of three light-chain CDR regions (LC CDR1, LC CDR2, and LC CDR3) and/or a heavy-chain CDR region comprising at least one CDR region of three heavy-chain CDR regions (HC CDR1, HC CDR2, and HC CDR3), and achieves the purposes and effects of the present invention, is included within the scope of the present invention.

TABLE 1

| No. | SEQ ID | LC CDR1 | SEQ ID | LC CDR2 | SEQ ID | LC CDR3 | SEQ ID | HC CDR1 | SEQ ID | HC CDR2 | SEQ ID | HC CDR3 |
|---|---|---|---|---|---|---|---|---|---|---|---|---|
| 1 | 1 | RASQSISSYLN | 2 | AASSLQS | 3 | QQSYSTPFT | 4 | DYAMH | 5 | GISWNSGRIGYADSVKG | 6 | GDCGGDCYSFLLGEDAFDI |
| 2 | 7 | RASQSISTYLN | 8 | AASSLQS | 9 | QQSYSIPHT | 10 | DYAMH | 11 | GISWNSGRIGYADSVKG | 12 | GDCGGDCYSFLLGEDAFDI |
| 3 | 13 | QASQDISNYLN | 14 | DASNLET | 15 | QQYDNLPIT | 16 | SYAMS | 17 | AISGSGGSTYYADSVKG | 18 | SLVSGRYCSGVTCYSWFDP |
| 4 | 19 | QASQDISNYLN | 20 | DASNLET | 21 | QQYDDLPIT | 22 | SYAMS | 23 | AISGSGGSTYYADSVKG | 24 | SLVSGRYCSGVTCYSWFDP |
| 5 | 25 | QASQDISNYLN | 26 | DASNLET | 27 | QQYDNLPIT | 28 | SYAMS | 29 | AISGSGGSTYYADSVKG | 30 | SLVSGRYCSGVTCYSWFDP |
| 6 | 31 | SGSSSNIGSNYVY | 32 | RNNQRPS | 33 | AAWDDSLSGKV | 34 | SYAIS | 35 | GIIPIFGTANYAQKFQD | 36 | DGVVVPAVMYDTTDPYYYGMDV |
| 7 | 37 | SGSSSNIGSNYVY | 38 | RNNQRPP | 39 | AAWDDSLSGRV | 40 | SYAIS | 41 | GIIPIFGTANYAQKFQG | 42 | DGVVVPAVMYDTTDPYYYGMDV |
| 8 | 43 | SGSSSNIGSNYVY | 44 | RNNQRPS | 45 | AAWDDSLSGRV | 46 | SYAIS | 47 | GIIPIFGTANYAQKFQG | 48 | DGVVVPAVMYDTTDPYYYGMDV |
| 9 | 49 | SGSSSNIGSNYVY | 50 | RNNQRPS | 51 | AAWDDSLNGRV | 52 | SYAIS | 53 | GIIPIFGTANYAQKFQG | 54 | DGVVVPAVMYDTTDPYYYGMDV |
| 10 | 55 | SGSSSNIGSNYVY | 56 | RNNQRPS | 57 | AAWDDSLSGRV | 58 | SYAIS | 59 | GIIPIFGTENYAQKFQG | 60 | DGVVVPAVMYDTTDPYYYGMDV |

TABLE 1-continued

| No. | SEQ ID | LC CDR1 | SEQ ID | LC CDR2 | SEQ ID | LC CDR3 | SEQ ID | HC CDR1 | SEQ ID | HC CDR2 | SEQ ID | HC CDR3 |
|---|---|---|---|---|---|---|---|---|---|---|---|---|
| 11 | 61 | SGSSSNIGSNYVY | 62 | RNNQRPS | 63 | AAWDDSLSGRV | 64 | SYAIS | 65 | GIIPIFGTENYAQKFQG | 66 | DGVVVPAVMYDTTDPYYYGMDV |
| 12 | 67 | SGSSSNIGSNYVY | 68 | RNNQRPS | 69 | AAWDDSLSGKV | 70 | SYAIS | 71 | GIIPIFGTANYAQKFQD | 72 | DGVVVPAVMYDTTDPYYYGMDV |
| 13 | 73 | SGSSSNIGNNYVY | 74 | GNYQRPS | 75 | AAWDDSLSGRV | 76 | SYAIS | 77 | GIIPIFGTANYAQKFQG | 78 | DGVVVPAVMYDTTDPYYYGMDV |
| 14 | 79 | SGSSSNIGGNYVH | 80 | SNDQRPS | 81 | AAWDDSLNGRV | 82 | SYAIS | 83 | GIIPIFGTANYAQKFQG | 84 | DGVVVPAVMYDTTDPYYYGMDV |
| 15 | 85 | SGSSSNIGSNYVY | 86 | RNNQRPP | 87 | AAWDDSLSGRV | 88 | SYAIS | 89 | GIIPIFGTANYAQKFQG | 90 | DGVVVPAVMYDTTDPYYYGMDV |
| 16 | 91 | SGSSSNIGSNYVY | 92 | RNNQRPS | 93 | AAWDDSLSGKV | 94 | SYAIS | 95 | GIIPIFGTANYAQKFQD | 96 | DGVVVPAVMYDTTDPYYYGMDV |
| 17 | 97 | SGSSSNIGSNYVY | 98 | RNNQRPS | 99 | AAWDDSLSGKV | 100 | SYAIS | 101 | GIIPIFGTANYAQKFQD | 102 | DGVVVPAVMYDTTDPYYYGMDV |
| 18 | 103 | TGSSSNIGAGYDVH | 104 | GNSNRPS | 105 | QSYDSSLSGKV | 106 | SYAIS | 107 | GIIPIFGTANYAQKFQG | 108 | DGVVVPAVMYDTTDPYYYGMDV |
| 19 | 109 | SGSSSNIGSNYVY | 110 | RNNQRPS | 111 | AAWDDSLSGRV | 112 | SYAIS | 113 | GIIPIFGTANYAQKFQG | 114 | DGVVVPAVMYDTTDPYYYGMDV |

TABLE 1-continued

| No. | SEQ ID | LC CDR1 | SEQ ID | LC CDR2 | SEQ ID | LC CDR3 | SEQ ID | HC CDR1 | SEQ ID | HC CDR2 | SEQ ID | HC CDR3 |
|---|---|---|---|---|---|---|---|---|---|---|---|---|
| 20 | 115 | SGSSSNIGSNYVY | 116 | RNNQRPS | 117 | AAWDDSLSGKV | 118 | SYAIS | 119 | GIIPIFGTANYAQKFQD | 120 | DGVVVPAVMYDTTDPYYYGMDV |
| 21 | 121 | SGSSSNIGSNYVY | 122 | RNNQRPS | 123 | AAWDDSLSGKV | 124 | SYAIS | 125 | GIIPIFGTANYAQKFQD | 126 | DGVVVPAVMYDTTDPYYYGMDV |
| 22 | 127 | SGSSSNIGSNYVY | 128 | RNNQRPS | 129 | AAWDDSLSGKV | 130 | SYAIS | 131 | GIIPIFGTANYAQKFQD | 132 | DGVVVPAVMYDTTDPYYYGMDV |
| 23 | 133 | SGSSSNIGSNYVY | 134 | RNNQRPS | 135 | AAWDDSLSGKV | 136 | SYAIS | 137 | GIIPIFGTANYAQKFQD | 138 | DGVVVPAVMYDTTDPYYYGMDV |
| 24 | 139 | SGSSSNIGSNYVY | 140 | RNNQRPP | 141 | AAWDDSLSGRV | 142 | SYAIS | 143 | GIIPIFGTANYAQKFQG | 144 | DGVVVPAVMYDTTDPYYYGMDV |
| 25 | 145 | SGSSSNIGSNYVY | 146 | RNNQRPS | 147 | AAWDDSLSGKV | 148 | SYAIS | 149 | GIIPIFGTANYAQKFQD | 150 | DGVVVPAVMYDTTDPYYYGMDV |
| 26 | 151 | SGSSSNIGSNYVY | 152 | RNNQRPS | 153 | AAWDDSLSGKV | 154 | SYAIS | 155 | GIIPIFGTANYAQKFQD | 156 | DGVVVPAVMYDTTDPYYYGMDV |
| 27 | 157 | SGSSSNIGSNYVY | 158 | RNNQRPS | 159 | AAWDDSLSGKV | 160 | SYAIS | 161 | GIIPIFGTANYAQKFQD | 162 | DGVVVPAVMYDTTDPYYYGMDV |
| 28 | 163 | SGSSSNIGSNYVY | 164 | RNNQRPS | 165 | AAWDDSLNGRV | 166 | SYAIS | 167 | GIIPIFGTANYAQKFQG | 168 | DGVVVPAVMYDTTDPYYYGMDV |

TABLE 1-continued

| No. | SEQ: ID | LC CDR1 | SEQ: ID | LC CDR2 | SEQ: ID | LC CDR3 | SEQ: ID | HC CDR1 | SEQ: ID | HC CDR2 | SEQ: ID | HC CDR3 |
|---|---|---|---|---|---|---|---|---|---|---|---|---|
| 29 | 169 | SGSSSNIGSNYVY | 170 | RNNQRPS | 171 | AAWDDSLSGKV | 172 | SYAIS | 173 | GIIPIFGTANYAQKFQD | 174 | DGVVVPAVMYDTTDPYYYGMDV |
| 30 | 175 | SGSSSNIGSNYVY | 176 | RNNQRPS | 177 | AAWDDSLSGKV | 178 | SYAIS | 179 | GIIPIFGTANYAQKFQD | 180 | DGVVVPAVMYDTTDPYYYGMDV |
| 31 | 181 | SGSSSNIGGNYVH | 182 | SNDQRPS | 183 | AAWDDSLSGRV | 184 | SYAIS | 185 | GIIPIFGTANYAQKFQG | 186 | DGVVVPAVMYDTTDPYYYGMDV |
| 32 | 187 | SGSSSNIGSNYVY | 188 | RNNQRPS | 189 | AAWDDSLSGKV | 190 | SYAIS | 191 | GIIPIFGTANYAQKFQD | 192 | DGVVVPAVMYDTTDPYYYGMDV |
| 33 | 193 | SGSSSNIGSNYVY | 194 | RNNQRPS | 195 | AAWDDSLSGKV | 196 | SYAIS | 197 | GIIPIFGTANYAQKFQD | 198 | DGVVVPAVMYDTTDPYYYGMDV |
| 34 | 199 | SGSSSNIGSNYVY | 200 | RNNQRPS | 201 | AAWDDSLSGRV | 202 | SYAIS | 203 | GIIPIFGTANYAQKFQG | 204 | DGVVVPAVMYDTTDPYYYGMDV |
| 35 | 205 | SGSSSNIGSNYVY | 206 | RNNQRPS | 207 | AAWDDSLSGRV | 208 | SYAIS | 209 | GIIPIFGTANYAQKFQG | 210 | DGVVVPAVMYDTTDPYYYGMDV |
| 36 | 211 | SGGSSNIGSNYVY | 212 | RNNQRPS | 213 | AAWDDSLSGRV | 214 | SYAIS | 215 | GIIPIFGTANYAQKFQG | 216 | DGVVVPAVMYDTTDPYYYGMDV |
| 37 | 217 | SGSSSNIGSNYVY | 218 | RNNQRPP | 219 | AAWDDSLSGRV | 220 | SYAIS | 221 | GIIPIFGTANYAQKFQG | 222 | DGVVVPAVMYDTTDPYYYGMDV |

TABLE 1-continued

| No. | SEQ: ID | LC CDR1 | SEQ: ID | LC CDR2 | SEQ: ID | LC CDR3 | SEQ: ID | HC CDR1 | SEQ: ID | HC CDR2 | SEQ: ID | HC CDR3 |
| --- | --- | --- | --- | --- | --- | --- | --- | --- | --- | --- | --- | --- |
| 38 | 223 | SGSSSNIGSNYVY | 224 | RNNQRPS | 225 | AAWDDSLSGRV | 226 | SYAIS | 227 | GIIPIFGTANYAQKFQG | 228 | DGVVVPAVMYDTTDPYYYGMDV |
| 39 | 229 | SGSSSNIGSNYVY | 230 | RNNQRPS | 231 | AAWDDSLSGRV | 232 | SYAIS | 233 | GIIPIFGTANYAQKFQG | 234 | DGVVVPAVMYDTTDPYYYGMDV |
| 40 | 235 | SGSSSNIGSNYVY | 236 | RNNQRPS | 237 | AAWDDSLSGRV | 238 | SYAIS | 239 | GIIPIFGTANYAQKFQG | 240 | DGVVVPAVMYDTTDPYYYGMDV |
| 41 | 241 | SGSSSNIGSNYVY | 242 | RNNQRPS | 243 | AAWDDSLSGKV | 244 | SYAIS | 245 | GIIPIFGTANYAQKFQD | 246 | DGVVVPAVMYDTTDPYYYGMDV |
| 42 | 247 | SGSSSNIGSNYVY | 248 | RNNQRPS | 249 | AAWDDSLSGKV | 250 | SYAIS | 251 | GIIPIFGTANYAQKFQD | 252 | DGVVVPAVMYDTTDPYYYGMDV |
| 43 | 253 | SGSSSNIGSNYVY | 254 | RNNQRPP | 255 | AAWDDSLSGRV | 256 | SYAIS | 257 | GIIPIFGTANYAQKFQG | 258 | DGVVVPAVMYDTTDPYYYGMDV |
| 44 | 259 | RASQSVSSYLA | 260 | DASNRAT | 261 | QQYVTTPYT | 262 | RSSYYWG | 263 | NIYYSGSTYYNPSLKS | 264 | GSRGYYDILTGYSTGGFDY |
| 45 | 265 | RASQSISSYLA | 266 | DASNRAT | 267 | QQYGSSPLT | 268 | SSSYYWG | 269 | NIFYSGSTYYNPSLKS | 270 | GSRGYYDILTGYSTGGFDY |
| 46 | 271 | RASQSVSSSYLA | 272 | GASSRAT | 273 | QQYGSSPLT | 274 | SSSYYWG | 275 | NIFYSGSTYYNPSLKS | 276 | GSRGYYDILTGYSTGGFDY |
| 47 | 277 | RASQSVSSSYLA | 278 | DASNRAT | 279 | QQYGSSPLT | 280 | SSSYYWG | 281 | NIFYSGSTYYNPSLKS | 282 | GSRGYYDILTGYSTGGFDY |

TABLE 1-continued

| No. | SEQ ID | LC CDR1 | SEQ ID | LC CDR2 | SEQ ID | LC CDR3 | SEQ ID | HC CDR1 | SEQ ID | HC CDR2 | SEQ ID | HC CDR3 |
|---|---|---|---|---|---|---|---|---|---|---|---|---|
| 48 | 283 | RASQSVSSSYLA | 284 | GASSRAT | 285 | QQYGSSPLT | 286 | HYFWS | 287 | NIYYSGSTYYNPSLKS | 288 | GSRGYYDILTGYSTGGFDY |
| 49 | 289 | TGTSSDVGGYNYVS | 290 | DVSNRPS | 291 | SSYTSSTVV | 292 | SSSYYWG | 293 | NIFYSGSTYYNPSLKS | 294 | GSRGYYDILTGYSTGGFDY |
| 50 | 295 | RASQSISSYLA | 296 | DASNRAT | 297 | QQYGSSPLT | 298 | SSSYYWG | 299 | NIFYSGSTYYNPSLKS | 300 | GSRGYYDILTGYSTGGFDY |
| 51 | 301 | RASQSISSYLA | 302 | DASNRAT | 303 | QQYGSSPLT | 304 | SSSYYWG | 305 | NIFYSGSTYYNPSLKS | 306 | GSRGYYDILTGYSTGGFDY |
| 52 | 307 | RASQSVSSSYLA | 308 | DASNRAT | 309 | QQYGSSPLT | 310 | SSSYYWG | 311 | NIFYSGSTYYNPSLKS | 312 | GSRGYYDILTGYSTGGFDY |
| 53 | 313 | RASQSISSYLA | 314 | GGSSRAT | 315 | QQYGSSPLT | 316 | SSSYYWG | 317 | NIFYSGSTYYNPSLKS | 318 | GSRGYYDILTGYSTGGFDY |
| 54 | 319 | TGTSSDVGGYNYVS | 320 | DVSNRPS | 321 | SSYTSSTHV | 322 | SSSYYWG | 323 | NIFYSGSTYYNPSLKS | 324 | GSRGYYDILTGYSTGGFDY |
| 55 | 325 | RASQSVSTYLA | 326 | DASNRAT | 327 | QQYGSSPSIT | 328 | SSSYYWG | 329 | NIFYSGSTYYNPSLKS | 330 | GSRGYYDILTGYSTGGFDY |
| 56 | 331 | RASQSVSSSYLA | 332 | GASSRAT | 333 | QEYGSSPGRVT | 334 | SSSYYWG | 335 | NIFYSGSTYYNPSLKS | 336 | GSRGYYDILTGYSTGGFDY |
| 57 | 337 | RASQSVSSSYLA | 338 | GASSRAT | 339 | QQYGSSPLT | 340 | SSSYYWG | 341 | NIFYSGSTYYNPSLKS | 342 | GSRGYYDILTGYSTGGFDY |
| 58 | 343 | RASQSVSSSYLA | 344 | GASSRAT | 345 | QQYGSSPLT | 346 | SSSYYWG | 347 | NIFYSGSTYYNPSLKS | 348 | GSRGYYDILTGYSTGGFDY |
| 59 | 349 | RASQSVSSSYLA | 350 | GASSRAT | 351 | QQYGSSPLT | 352 | SSSYYWG | 353 | NIFYSGSTYYNPSLKS | 354 | GSRGYYDILTGYSTGGFDY |

TABLE 1-continued

| No. | SEQ: ID | LC CDR1 | SEQ: ID | LC CDR2 | SEQ: ID | LC CDR3 | SEQ: ID | HC CDR1 | SEQ: ID | HC CDR2 | SEQ: ID | HC CDR3 |
|---|---|---|---|---|---|---|---|---|---|---|---|---|
| 60 | 355 | RASQSVSSSYLA | 356 | GASSRAT | 357 | QQYGSSPLT | 358 | SSSYWG | 359 | NIFYSGSTYYNPSLKS | 360 | GSRGYYDILTGYSTGGFDY |
| 61 | 361 | RASQSVSSYLA | 362 | DASNRAT | 363 | QQYYSTPSIT | 364 | SSSYWG | 365 | NIFYSGSTYYNPSLKS | 366 | GSRGYYDILTGYSTGGFDY |
| 62 | 367 | RASQSVSSSYLA | 368 | DASNRAT | 369 | QQYGSSPLT | 370 | SSSYWG | 371 | NIFYSGSTYYNPSLKS | 372 | GSRGYYDILTGYSTGGFDY |
| 63 | 373 | TGTSSDVGGYNYVS | 374 | DVSNRPS | 375 | SSYTSSSTWV | 376 | SSSYWG | 377 | NIFYSGSTYYNPSLKS | 378 | GSRGYYDILTGYSTGGFDY |
| 64 | 379 | RASQSVSSSYLA | 380 | GASSRAT | 381 | QQYGSSPLT | 382 | SSSYWG | 383 | NIFYSGSTYYNPSLKS | 384 | GSRGYYDILTGYSTGGFDY |
| 65 | 385 | RASQSVSSSFLA | 386 | GASSRAT | 387 | QEYGSSPGRVT | 388 | SSSYWG | 389 | NIFYSGSTYYNPSLKS | 390 | GSRGYYDILTGYSTGGFDY |
| 66 | 391 | RASQSVSNYLA | 392 | DASNRAT | 393 | QQYGSSPLT | 394 | SSSYWG | 395 | NIFYSGSTYYNPSLKS | 396 | GSRGYYDILTGYSTGGFDY |
| 67 | 397 | RASQSVSNYLA | 398 | DASNRAT | 399 | QQYGSSPLT | 400 | SSSYWG | 401 | NIFYSGSTYYNPSLKS | 402 | GSRGYYDILTGYSTGGFDY |
| 68 | 403 | RASQSVSSSYLA | 404 | GASSRAT | 405 | QEYGSSPGRVT | 406 | SSSYWG | 407 | NIFYSGSTYYNPSLKS | 408 | GSRGYYDILTGYSTGGFDY |
| 69 | 409 | RASQSVRSSYLA | 410 | AASTRAT | 411 | QQYGDSLSIT | 412 | SSSYWG | 413 | NIFYSGSTYYNPSLKS | 414 | GSRGYYDILTGYSTGGFDY |
| 70 | 415 | RASQSVSSYLA | 416 | DASNRAT | 417 | QQYGSSPSIT | 418 | SSSYWG | 419 | NIFYSGSTYYNPSLKS | 420 | GSRGYYDILTGYSTGGFDY |
| 71 | 421 | RASQSVSSNLA | 422 | DASTRAT | 423 | QQYNNWPLT | 424 | SSSYWG | 425 | NIFYSGSTYYNPSLKS | 426 | GSRGYYDILTGYSTGGFDY |

TABLE 1-continued

| No. | SEQ ID | LC CDR1 | SEQ ID | LC CDR2 | SEQ ID | LC CDR3 | SEQ ID | HC CDR1 | SEQ ID | HC CDR2 | SEQ ID | HC CDR3 |
|---|---|---|---|---|---|---|---|---|---|---|---|---|
| 72 | 427 | SGSSSNIGSNYVS | 428 | DVSNRPS | 429 | SSYTSSSTLP | 430 | SSSYYWG | 431 | NIFYSGSTYYNPSLKS | 432 | GSRGYYDILTGYSTGGFDY |
| 73 | 433 | RASQSVSSSFLA | 434 | GASSRAT | 435 | QEYGSSPGRVT | 436 | SSSYYWG | 437 | NIFYSGSTYYNPSLKS | 438 | GSRGYYDILTGYSTGGFDY |
| 74 | 439 | RASQSVSNYLA | 440 | DASNRAT | 441 | QQYGSSPLT | 442 | SSSYYWG | 443 | NIFYSGSTYYNPSLKS | 444 | GSRGYYDILTGYSTGGFDY |
| 75 | 445 | RASQSVSSSYLA | 446 | GASSRAT | 447 | QQYGSSPLT | 448 | SSSYYWG | 449 | NIFYSGSTYYNPSLKS | 450 | GSRGYYDILTGYSTGGFDY |
| 76 | 451 | RASQSVSSSYLA | 452 | DASNRAT | 453 | QQYGSSPLT | 454 | SSSYYWG | 455 | NIFYSGSTYYNPSLKS | 456 | GSRGYYDILTGYSTGGFDY |
| 77 | 457 | RASQSVSSNLA | 458 | DASTRAT | 459 | QQYNNWPLT | 460 | SSSYYWG | 461 | NIFYSGSTYYNPSLKS | 462 | GSRGYYDILTGYSTGGFDY |
| 78 | 463 | RASQSVSSSYLA | 464 | DASNRAT | 465 | QQYGSSPLT | 466 | SSSYYWG | 467 | NIFYSGSTYYNPSLKS | 468 | GSRGYYDILTGYSTGGFDY |
| 79 | 469 | RASQSVSSYLA | 470 | DASNRAT | 471 | QQYYSTPSIT | 472 | SSSYYWG | 473 | NIFYSGSTYYNPSLKS | 474 | GSRGYYDILTGYSTGGFDY |
| 80 | 475 | RASQSVSNYLA | 476 | DASNRAT | 477 | QQYGSSPLT | 478 | SSSYYWG | 479 | NIFYSGSTYYNPSLKS | 480 | GSRGYYDILTGYSTGGFDY |
| 81 | 481 | RASQSVSSYLA | 482 | DASNRAT | 483 | QQYGSSPLT | 484 | SSSYYWG | 485 | NIFYSGSTYYNPSLKS | 486 | GSRGYYDILTGYSTGGFDY |
| 82 | 48 | RASQSVSSYLA | 488 | DASNRAT | 489 | QQYGSSPLT | 490 | SSSYYWG | 491 | NIFYSGSTYYNPSLKS | 492 | GSRGYYDILTGYSTGGFDY |
| 83 | 493 | RASQSVSSNLA | 494 | GASTRAT | 495 | QQYNNWPLT | 496 | GSSYYWG | 497 | NIFYSGSTYYNPSLKS | 498 | GSRGYYDILTGYSTGGFDY |

TABLE 1-continued

| No. | SEQ ID | LC CDR1 | SEQ ID | LC CDR2 | SEQ ID | LC CDR3 | SEQ ID | HC CDR1 | SEQ ID | HC CDR2 | SEQ ID | HC CDR3 |
|---|---|---|---|---|---|---|---|---|---|---|---|---|
| 84 | 499 | TGTSSDVGGYNYVS | 500 | DVSNRPS | 501 | SSYTSSSTWV | 502 | SSSYYWG | 503 | NIFYSGSTYYNPSLKS | 504 | GSRGYYDILTGYSTGGFDY |
| 85 | 505 | RASQSISSYLA | 506 | DASNRAT | 507 | QQYGSSPLT | 508 | SSSYYWG | 509 | NIFYSGSTYYNPSLKS | 510 | GSRGYYDILTGYSTGGFDY |
| 86 | 511 | RASQSVSSYLA | 512 | DASSRAT | 513 | QQYGSSPYT | 514 | SSSYYWG | 515 | NIFYSGSTYYNPSLKS | 516 | GSRGYYDILTGYSTGGFDY |
| 87 | 517 | RASQSVSNYLA | 518 | DASNRAT | 519 | QQYGSSPLT | 520 | SSSYYWG | 521 | NIFYSGSTYYNPSLKS | 522 | GSRGYYDILTGYSTGGFDY |
| 88 | 523 | RASQSVSSYLA | 524 | DASNRAT | 525 | QQYGSSPSIT | 526 | SSSYYWG | 527 | SIYYSGSTYYNPSLKS | 528 | GSRGYYDFLTGYSTGGFDY |
| 89 | 529 | SGSSSNIGDNYVS | 530 | DNDKRPS | 531 | GTWDSSLSAVV | 532 | TSGMGVG | 533 | LIDWDDNKYYTSLKT | 534 | IPGFLRYRNRYYYYGMDV |
| 90 | 535 | SGSSSNIGNNYVS | 536 | DNNKRPS | 537 | GTWDSSLSAGV | 538 | TSGMGVG | 539 | LIDWDDNKYYTSLKT | 540 | IPGFLRYRNRYYYYGMDV |
| 91 | 541 | SGSSSNIGNNYVS | 542 | DNNKRPS | 543 | GTWDNSLSAGV | 544 | TSGVGVG | 545 | LIDWDDNKYYTSLKT | 546 | IPGFLRYRNRYYYYGMDV |
| 92 | 547 | SGSSSNIGNNYVS | 548 | DNNKRPS | 549 | GTWDSSLSAGV | 550 | TSGMGVG | 551 | LIDWDDNKYYTSLKT | 552 | IPGFLRYRNRYYYYGMDV |
| 93 | 553 | SGSSSNIGNNYVS | 554 | DNNKRPS | 555 | GTWDSSLSAGR | 556 | TSGVGVG | 557 | LIDWDDNKYYTSLKT | 558 | IPGFLRYRNRYYYYGMDV |
| 94 | 559 | SGSSSNIGNNYVS | 560 | DNNKRPS | 561 | GTWDSSLSAGV | 562 | TSGMGVG | 563 | LIDWDDNKYYTSLKT | 564 | IPGFLRYRNRYYYYGMDV |
| 95 | 565 | SGSSSNIGNNYVS | 566 | DNNKRPS | 567 | GTWDSSLSAGV | 568 | TSGVGVG | 569 | LIDWDDNKYYTSLKT | 570 | IPGFLRYRNRYYYYGMDV |

TABLE 1-continued

| No. | SEQ ID | LC CDR1 | SEQ ID | LC CDR2 | SEQ ID | LC CDR3 | SEQ ID | HC CDR1 | SEQ ID | HC CDR2 | SEQ ID | HC CDR3 |
|---|---|---|---|---|---|---|---|---|---|---|---|---|
| 96 | 571 | SGSSSNIGNNYVS | 572 | DNNKRPS | 573 | GTWDSSLSAGV | 574 | TSGMGVG | 575 | LIDWDDNKYYTSLKT | 576 | IPGFLRYRNRYYYYGMDV |
| 97 | 577 | SGSSSNIGNNYVS | 578 | DNNKRPS | 579 | GTWDSSLSAGV | 580 | TSGMGVS | 581 | LIDWDDNKYYTSLKT | 582 | IPGFLRYRNRYYYYGMDV |
| 98 | 583 | SGSSSNIGNNYVS | 584 | DNNKRPS | 585 | GTWDSSLSAGV | 586 | TSGMGVG | 587 | LIDWDDNKYYTSLKT | 588 | IPGFLRYRNRYYYYGMDV |
| 99 | 589 | SGSSSNIGNNYVS | 590 | DNNKRPS | 591 | GTWDSSLSAGV | 592 | TSGMGVG | 593 | LIDWDDNKYYTSLKT | 594 | IPGFLRYRNRYYYYGMDV |
| 100 | 595 | SGSSSNIGNNYVS | 596 | DNNKRPS | 597 | GTWDSSLSAGV | 598 | TSGMGVG | 599 | LIDWDDNKYYTSLKT | 600 | IPGFLRYRNRYYYYGMDV |
| 101 | 601 | SGSSSNIGNNYVS | 602 | DNNKRPS | 603 | GTWDSSLSAGV | 604 | TSGMGVG | 605 | LIDWDDNKYYTSLKT | 606 | IPGFLRYRNRYYYYGMDV |
| 102 | 607 | SGSSSNIGNNYVS | 608 | DNNKRPS | 609 | GTWDSSLSAGV | 610 | TSGMGVG | 611 | LIDWDDNKYYTSLKT | 612 | IPGFLRYRNRYYYYGMDV |
| 103 | 613 | SGSSSNIGKNYVS | 614 | DNNKRPS | 615 | GTWDSSLSAVV | 616 | TSGVGVG | 617 | LIDWDDNKYYTSLKT | 618 | IPGFLRYRNRYYYYGMDV |
| 104 | 619 | SGGSSNIGNNYVS | 620 | DNNKRPS | 621 | GTWDSSLSAGV | 622 | TSGVGVG | 623 | LIDWDDNKYYTSLKT | 624 | IPGFLRYRNRYYYYGMDV |
| 105 | 625 | SGSSSNIGNNYVS | 626 | DNNKRPS | 627 | GTWDSSLSAGV | 628 | TSGVGVG | 629 | LIDWDDNKYYTSLKT | 630 | IPGFLRYRNRYYYYGMDV |
| 106 | 631 | SGSSSNIGNNYVS | 632 | DNNKRPS | 633 | GTWDSSLSAGV | 634 | TSGMGVG | 635 | LIDWDDNKYYTSLKT | 636 | IPGFLRYRNRYYYYGMDV |
| 107 | 637 | SGSSSNIGNNYVS | 638 | DNNKRPS | 639 | GTWDSSLSAGV | 640 | TSGMGVG | 641 | LIDWDDNKYYTSLKT | 642 | IPGFLRYRNRYYYYGMDV |

TABLE 1-continued

| No. | SEQ ID | LC CDR1 | SEQ ID | LC CDR2 | SEQ ID | LC CDR3 | SEQ ID | HC CDR1 | SEQ ID | HC CDR2 | SEQ ID | HC CDR3 |
|---|---|---|---|---|---|---|---|---|---|---|---|---|
| 108 | 643 | SGSSSNIGNNYVS | 644 | DNNKRPS | 645 | GTWDSSLSAGV | 646 | TSGMGVG | 647 | LIDWDDNKYYTSLKT | 648 | IPGFLRYRNRYYYGMDV |
| 109 | 649 | SGSSSNIGNNYVS | 650 | DNNKRPS | 651 | GTWDSSLSAGV | 652 | TSGMGVG | 653 | LIDWDDNKYYTSLKT | 654 | IPGFLRYRNRYYYGMDV |
| 110 | 655 | SGSSSNIGNNYVS | 656 | DNNKRPS | 657 | GTWDSSLSAGV | 658 | TSGMGVG | 659 | LIDWDDNKYYTSLKT | 660 | IPGFLRYRNRYYYGMDV |
| 111 | 661 | SGSSSNIGNNYVS | 662 | DNNKRPS | 663 | GTWDSSLSAGV | 664 | TSGMGVG | 665 | LIDWDDNKYYTSLKT | 666 | IPGFLRYRNRYYYGMDV |
| 112 | 667 | SGSSSNIGNNYVS | 668 | DNNKRPS | 669 | GTWDSSLSAGV | 670 | TSGVGVG | 671 | LIDWDDNKYYTSLKT | 672 | IPGFLRYRNRYYYGMDV |
| 113 | 673 | SGSNSNIGNNYIS | 674 | DNNKRPS | 675 | GTWDSSLSAGV | 676 | TSGVGVG | 677 | LIDWDDNKYYTSLKT | 678 | IPGFLRYRNRYYYGMDV |
| 114 | 679 | SGSSSNIGNNYVS | 680 | DNNKRPS | 681 | GTWDSSLSAGV | 682 | TSGMGVG | 683 | LIDWDDNKYYTSLKT | 684 | IPGFLRYRNRYYYGMDV |
| 115 | 685 | SGSSSNIGNNYVS | 686 | DNNKRPS | 687 | GTWDSSLSAGV | 688 | TSGMGVG | 689 | LIDWDDNKYYTSLKT | 690 | IPGFLRYRNRYYYGMDV |
| 116 | 691 | SGSSSNIGNNYVS | 692 | DNNKRPS | 693 | GTWDSSLSAGV | 694 | TSGMGVG | 695 | LIDWDDNKYYTSLKT | 696 | IPGFLRYRNRYYYGMDV |
| 117 | 697 | SGSSSNIGNNYVS | 698 | DNNKRPS | 699 | GTWDSSLSAGV | 700 | TSGMGVG | 701 | LIDWDDNKYYTSLKT | 702 | IPGFLRYRNRYYYGMDV |
| 118 | 703 | SGSNSNIGNNYVS | 704 | DNNKRPS | 705 | GTWDNSLSAGV | 706 | TSGMGVG | 70 | LIDWDDNKYYTSLKT | 708 | IPGFLRYRNRYYYGMDV |
| 119 | 709 | SGSSSNIGNNYVS | 710 | DNNKRPS | 711 | GTWDSSLSAGV | 712 | TSGMGVG | 713 | LIDWDDNKYYTSLKT | 714 | IPGFLRYRNRYYYGMDV |

TABLE 1-continued

| No. | SEQ ID | LC CDR1 | SEQ ID | LC CDR2 | SEQ ID | LC CDR3 | SEQ ID | HC CDR1 | SEQ ID | HC CDR2 | SEQ ID | HC CDR3 |
|---|---|---|---|---|---|---|---|---|---|---|---|---|
| 120 | 715 | SGSSSNIGNNYVS | 716 | DNNKRPS | 717 | GTWDSSLSAVV | 718 | TSGVGVG | 719 | LIDWDDNKYYTSLKT | 720 | IPGFLRYRNRYYYGMDV |
| 121 | 721 | SGSSSNIGNNYVS | 722 | DNNKRPS | 723 | GTWDSSLSAGV | 724 | TSGMGVG | 725 | LIDWDDNKYYTSLKT | 726 | IPGFLRYRNRYYYGMDV |
| 122 | 727 | SGSSSNIGNNYVS | 728 | DNNKRPS | 729 | GTWDSSLSAGV | 730 | TSGMGVG | 731 | LIDWDDNKYYTSLKT | 732 | IPGFLRYRNRYYYGMDV |
| 123 | 733 | SGSSSNIGNNYVS | 734 | DNNKRPS | 735 | GTWDSSLSAGV | 736 | TSGMGVG | 737 | LIDWDDNKYYTSLKT | 738 | IPGFLRYRNRYYYGMDV |
| 124 | 739 | SGSSSNIGNNYVS | 740 | DNNKRPS | 741 | GTWDNSLSAGV | 742 | TSGVGVG | 743 | LIDWDDNKYYTSLKT | 744 | IPGFLRYRNRYYYGMDV |
| 125 | 745 | SGSSSNIGNNYVS | 746 | DNNKRPS | 747 | GTWDSSLSAGV | 748 | TSGMGVG | 749 | LIDWDDNKYYTSLKT | 750 | IPGFLRYRNRYYYGMDV |
| 126 | 751 | SGSSSNIGNNYVS | 752 | DNNKRPS | 753 | GTWDSSLSAGV | 754 | TSGMGVG | 755 | LIDWDDNKYYTSLKT | 756 | IPGFLRYRNRYYYGMDV |
| 127 | 757 | SGSSSNIGNNYVS | 758 | DNNKRPS | 759 | GTWDNSLSAGV | 760 | TSGVGVG | 761 | LIDWDDNKYYTSLKT | 762 | IPGFLRYRNRYYYGMDV |
| 128 | 763 | SGSTSNIGNNFVS | 764 | DNDKRPS | 765 | GTWDSSLSAGV | 766 | TSGVGVG | 767 | LIDWDDNKYYTSLKT | 768 | IPGFLRYRNRYYYGMDV |
| 129 | 769 | SGSNSNIGNNYVS | 770 | DNNKRPS | 771 | GTWDNNLSAGV | 772 | TSGVGVG | 773 | LIDWDDNKYYTSLKT | 774 | IPGFLRYRNRYYYGMDV |
| 130 | 775 | SGSSSNIGNNYVS | 776 | DNNKRPS | 777 | GTWDSSLSAGV | 778 | TSGMGVG | 779 | LIDWDDNKYYTSLKT | 780 | IPGFLRYRNRYYYGMDV |
| 131 | 781 | SGSSSNIGNNYVS | 782 | DNNKRPS | 783 | GTWDSSLSAGV | 784 | TSGVGVG | 785 | LIDWDDNKYYTSLKT | 786 | IPGFLRYRNRYYYGMDV |

TABLE 1-continued

| No. | SEQ ID | LC CDR1 | SEQ ID | LC CDR2 | SEQ ID | LC CDR3 | SEQ ID | HC CDR1 | SEQ ID | HC CDR2 | SEQ ID | HC CDR3 |
|---|---|---|---|---|---|---|---|---|---|---|---|---|
| 132 | 787 | SGSSSNIGNNYVS | 788 | DNNKRPS | 789 | GTWDSSLSAGV | 790 | TSGMGVG | 791 | LIDWDDNKYYTSLKT | 792 | IPGFLRYRNRYYYGMDV |
| 133 | 793 | SGSSSNIGNNYVS | 794 | DNNKRPS | 795 | GTWDSSLSAGV | 796 | TSGMGVG | 797 | LIDWDDNKYYTSLKT | 798 | IPGFLRYRNRYYYGMDV |
| 134 | 799 | SGSSSNIGNNYVS | 800 | DNNKRPS | 801 | GTWDSSLSAGV | 802 | TSGMGVG | 803 | LIDWDDNKYYTSLKT | 804 | IPGFLRYRNRYYYGMDV |
| 135 | 805 | SGSSSNIGNNYVS | 806 | DNNKRPS | 807 | GTWDSSLSAGV | 808 | TSGMGVG | 809 | LIDWDDNKYYTSLKT | 810 | IPGFLRYRNRYYYGMDV |
| 136 | 811 | SGSSSNIGNNYVS | 812 | DNNKRPS | 813 | GTWDSSLSAGV | 814 | TSGMGVG | 815 | LIDWDDNKYYTSLKT | 816 | IPGFLRYRNRYYYGMDV |
| 137 | 817 | SGSSSNIGNNYVS | 818 | DNNKRPS | 819 | GTWDSSLSAGV | 820 | TSGVGVG | 821 | LIDWDDNKYYTSLKT | 822 | IPGFLRYRNRYYYGMDV |
| 138 | 823 | SGSSSNIGNNYVS | 824 | DNNKRPS | 825 | GTWDSSLSAGV | 826 | TSGVGVG | 827 | LIDWDDNKYYTSLKT | 828 | IPGFLRYRNRYYYGMDV |
| 139 | 829 | SGSSSNIGNNYVS | 830 | DNNKRPS | 831 | GTWDSSLSAGV | 832 | TSGVGVG | 833 | LIDWDDNKYHTSLKT | 834 | IPGFLRYRNRYYYGMDV |
| 140 | 835 | SGSSSNIGNNYVS | 836 | DNNKRPS | 837 | GTWDSSLSAGV | 838 | TSGMGVS | 839 | LIDWDDNKYYTSLKT | 840 | IPGFLRYRNRYYYGMDV |
| 141 | 841 | SGSSSNIGNNYVS | 842 | DNNKRPS | 843 | GTWDSSLSAGV | 844 | TSGMGVG | 845 | LIDWDDNKYYTSLKT | 846 | IPGFLRYRNRYYYGMDV |
| 142 | 847 | SGSSSNIGNNYVS | 848 | DNNKRPS | 849 | GTWDSSLSAGV | 850 | TSGMGVG | 851 | LIDWDDNKYYTSLKT | 852 | IPGFLRYRNRYYYGMDV |
| 143 | 853 | SGSSSNIGNNYVS | 854 | DNNKRPS | 855 | GTWDSSLSAGV | 856 | TSGVGVG | 857 | LIDWDDNKYYTSLKT | 858 | IPGFLRYRNRYYYGMDV |

TABLE 1-continued

| SEQ. No. | SEQ ID | LC CDR1 | SEQ ID | LC CDR2 | SEQ ID | LC CDR3 | SEQ ID | HC CDR1 | SEQ ID | HC CDR2 | SEQ ID | HC CDR3 |
|---|---|---|---|---|---|---|---|---|---|---|---|---|
| 144 | 859 | SGSSSNIGNNYVS | 860 | DNNKRPS | 861 | GTWDSSLSAGV | 862 | TSGMGVG | 863 | LIDWDDNKYYTSLKT | 864 | IPGFLRYRNRYYYGMDV |
| 145 | 865 | SGSSSNIGKNYVS | 866 | DNNKRPS | 867 | GTWDSSLSAVV | 868 | TSGVGVG | 869 | LIDWDDNKYYTSLKT | 870 | IPGFLRYRNRYYYGMDV |
| 146 | 871 | SGSSSNIGNNYVS | 872 | DNNKRPS | 873 | GTWDSSLSAGV | 874 | TSGMGVG | 875 | LIDWDDNKYYTSLKT | 876 | IPGFLRYRNRYYYGMDV |
| 147 | 877 | SGSSSNIGNNYVS | 878 | DNNKRPS | 879 | GTWDSSLSGGV | 880 | TSGMGVG | 881 | LIDWDDNKYYTSLKT | 882 | IPGFLRYRNRYYYGMDV |
| 148 | 883 | SGSSSNIGNNYVS | 884 | DNNKRPS | 885 | GTWDSSLSAGV | 886 | TSGMGVG | 887 | LIDWDDNKYYTSLKT | 888 | IPGFLRYRNRYYYGMDV |
| 149 | 889 | SGSSSNIGNNYVS | 890 | DNNKRPS | 891 | GTWDSSLSAGV | 892 | TSGMGVG | 893 | LIDWDDNKYYTSLKT | 894 | IPGFLRYRNRYYYGMDV |
| 150 | 895 | SGSSSNIGNNYVS | 896 | DNNKRPS | 897 | GTWDSSLSAGV | 898 | TSGMGVG | 899 | LIDWDDNKYYTSLKT | 900 | IPGFLRYRNRYYYGMDV |
| 151 | 901 | SGSSSNIGNNYVS | 902 | DNNKRPS | 903 | GTWDSSLSAGV | 904 | TSGVGVG | 905 | LIDWDDNKYYTSLKT | 906 | IPGFLRYRNRYYYGMDV |
| 152 | 907 | SGRSSNIGNNYVS | 908 | DNNKRPS | 909 | GTWDSSLSAGV | 910 | TSGMGVG | 911 | LIDWDDNKYYTSLKT | 912 | IPGFLRYRNRYYYGMDV |
| 153 | 913 | SGSSSNIGNNYVS | 914 | DNNKRPS | 915 | GTWDSSLSAGV | 916 | TSGVGVG | 917 | LIDWDDNKYYTSLKT | 918 | IPGFLRYRNRYYYGMDV |
| 154 | 919 | SGSSSNIGKNYVS | 920 | DNNKRPS | 921 | GTWDSSLSAVV | 922 | TSGVGVG | 923 | LIDWDDNKYYTSLKT | 924 | IPGFLRYRNRYYYGMDV |
| 155 | 925 | SGSSSNIGNNYVS | 926 | DNNKRPS | 927 | GTWDSSLSAGV | 928 | TSGMGVG | 929 | LIDWDDNKYYTSLKT | 930 | IPGFLRYRNRYYYGMDV |

TABLE 1-continued

| No. | SEQ: ID | LC CDR1 | SEQ: ID | LC CDR2 | SEQ: ID | LC CDR3 | SEQ: ID | HC CDR1 | SEQ: ID | HC CDR2 | SEQ: ID | HC CDR3 |
|---|---|---|---|---|---|---|---|---|---|---|---|---|
| 156 | 931 | SGSSSNIGNNYVS | 932 | DNNKRPS | 933 | GTWDSSLSAGV | 934 | TSGMGVG | 935 | LIDWDDNKYYTSLKT | 936 | IPGFLRYRNRYYYGMDV |
| 157 | 937 | SGSSSNIGNNYVS | 938 | DNNKRPS | 939 | GTWDSSLSAVV | 940 | TSGVGVG | 941 | LIDWDDNKYYTSLKT | 942 | IPGFLRYRNRYYYGMDV |
| 158 | 943 | SGSSSNIGNNYVS | 944 | DNNKRPS | 945 | GTWDSSLSAVV | 946 | TSGVGVG | 947 | LIDWDDNKYYTSLKT | 948 | IPGFLRYRNRYYYGMDV |
| 159 | 949 | SGSSSNIGNNYVS | 950 | DNNKRPS | 951 | GTWDSSLSAGV | 952 | TSGVGVG | 953 | LIDWDDNKYYTSLKT | 954 | IPGFLRYRNRYYYGMDV |
| 160 | 955 | SGSSSNIGNNYVS | 956 | DNNKRPS | 957 | GTWDSSLSAGV | 958 | TSGVGVG | 959 | LIDWDDNKYYTSLKT | 960 | IPGFLRYRNRYYYGMDV |
| 161 | 961 | SGSSSNIGNNYVS | 962 | DNNKRPS | 963 | GTWDSSLSAGV | 964 | TSGMGVG | 965 | LIDWDDNKYYTSLKT | 966 | IPGFLRYRNRYYYGMDV |
| 162 | 967 | SGSSSNIGKNYVS | 968 | DNNKRPS | 969 | GTWDSSLSAVV | 970 | TSGVGVG | 971 | LIDWDDNKYYTSLKT | 972 | IPGFLRYRNRYYYGMDV |
| 163 | 973 | SGSSSNIGNNYVS | 974 | DNNKRPS | 975 | GTWDSSLSAGV | 976 | TSGMGVG | 977 | LIDWDDNKYYTSLKT | 978 | IPGFLRYRNRYYYGMDV |
| 164 | 979 | SGSSSNIGNNYVS | 980 | DNNKRPS | 981 | GTWDSSLSAGV | 982 | TSGVGVG | 983 | LIDWDDNKYYTSLKT | 984 | IPGFLRYRNRYYYGMDV |
| 165 | 985 | SGSSSNIGNNYVS | 986 | DNNKRPS | 987 | GTWDSSLSAGV | 988 | TSGMGVG | 989 | LIDWDDNKYYTSLKT | 990 | IPGFLRYRNRYYYGMDV |
| 166 | 991 | SGSSSNIGNNYVS | 992 | DNNKRPS | 993 | GTWDSSLSAGV | 994 | TSGMGVG | 995 | LIDWDDNKYYTSLKT | 996 | IPGFLRYRNRYYYGMDV |
| 167 | 997 | SGSSSNIGNNYVS | 998 | DNNKRPS | 999 | GTWDSSLSAGV | 1000 | TSGVGVG | 1001 | LIDWDDNKYYTSLKT | 1002 | IPGFLRYRNRYYYGMDV |

TABLE 1-continued

| No. | SEQ: ID | LC CDR1 | SEQ: ID | LC CDR2 | SEQ: ID | LC CDR3 | SEQ: ID | HC CDR1 | SEQ: ID | HC CDR2 | SEQ: ID | HC CDR3 |
|---|---|---|---|---|---|---|---|---|---|---|---|---|
| 168 | 1003 | SGSSSNIGNNYVS | 1004 | DNNKRPS | 1005 | GTWDSSLSAGV | 1006 | TSGMGVG | 1007 | LIDWDDNKYYTSLKT | 1008 | IPGFLRYRNRYYYGMDV |
| 169 | 1009 | SGSSSNIGKNYVS | 1010 | DNNKRPS | 1011 | GTWDSSLSAVV | 1012 | TSGVGVG | 1013 | LIDWDDNKYYTSLKT | 1014 | IPGFLRYRNRYYYGMDV |
| 170 | 1015 | SGSSSNIGNNYVS | 1016 | DNNKRPS | 1017 | GTWDSSLSAGV | 1018 | TSGMGVG | 1019 | LIDWDDNKYYTSLKT | 1020 | IPGFLRYRNRYYYGMDV |
| 171 | 1021 | SGRSSNIGNNYVS | 1022 | DNNKRPS | 1023 | GTWDSSLSAGV | 1024 | TSGMGVG | 1025 | LIDWDDNKYYTSLKT | 1026 | IPGFLRYRNRYYYGMDV |
| 172 | 1027 | SGSSSNIGNNYVS | 1028 | DNNKRPS | 1029 | GTWDSSLSAGV | 1030 | TSGVGVG | 1031 | LIDWDDNKYYTSLKT | 1032 | IPGFLRYRNRYYYGMDV |
| 173 | 1033 | SGSSSNIGNNYVS | 1034 | DNNKRPS | 1035 | GTWDSSLSAGV | 1036 | TSGVGVG | 1037 | LIDWDDNKYYTSLKT | 1038 | IPGFLRYRNRYYYGMDV |
| 174 | 1039 | SGSSSNIGNNYVS | 1040 | DNNKRPS | 1041 | GTWDSSLSAGV | 1042 | TSGMGVG | 1043 | LIDWDDNKYYTSLKT | 1044 | IPGFLRYRNRYYYGMDV |
| 175 | 1045 | SGSSSNIGNNYVS | 1046 | DNNKRPS | 1047 | GTWDSSLSAGV | 1048 | TSGMGVG | 1049 | LIDWDDNKYYTSLKT | 1050 | IPGFLRYRNRYYYGMDV |
| 176 | 1051 | SGSSSNIGNNYVS | 1052 | DNNKRPS | 1053 | GTWDSSLSAGV | 1054 | TSGVGVG | 1055 | LIDWDDNKYYTSLKT | 1056 | IPGFLRYRNRYYYGMDV |
| 177 | 1057 | SGSSSNIGNNYVS | 1058 | DNNKRPS | 1059 | GTWDSSLSAGV | 1060 | TSGVGVG | 1061 | LIDWDDNKYYTSLKT | 1062 | IPGFLRYRNRYYYGMDV |
| 178 | 1063 | SGSSSNIGNNYVS | 1064 | DNNKRPS | 1065 | GTWDSSLSAGV | 1066 | TSGMGVG | 1067 | LIDWDDNKYYTSLKT | 1068 | IPGFLRYRNRYYYGMDV |
| 179 | 1069 | SGSSSNIGNNYVS | 1070 | DNNKRPS | 1071 | GTWDSSLSAGV | 1072 | TSGMGVG | 1073 | LIDWDDNKYYTSLKT | 1074 | IPGFLRYRNRYYYGMDV |

TABLE 1-continued

| No. | SEQ: ID | LC CDR1 | SEQ: ID | LC CDR2 | SEQ: ID | LC CDR3 | SEQ: ID | HC CDR1 | SEQ: ID | HC CDR2 | SEQ: ID | HC CDR3 |
|---|---|---|---|---|---|---|---|---|---|---|---|---|
| 180 | 1075 | SGSSSNIGNNYVS | 1076 | DNNKRPS | 1077 | GTWDSSLSAGV | 1078 | TSGMGVG | 1079 | LIDWDDNKYYTSLKT | 1080 | IPGFLRYRNRYYYGMDV |
| 181 | 1081 | SGSSSNIGNNYVS | 1082 | DNNKRPS | 1083 | GTWDSSLSAGV | 1084 | TSGMGVG | 1085 | LIDWDDNKYYTSLKT | 1086 | IPGFLRYRNRYYYGMDV |
| 182 | 1087 | SGSSSNIGNNYVS | 1088 | DNNKRPS | 1089 | GTWDSSLSAGV | 1090 | TSGVGVG | 1091 | LIDWDDNKYYTSLKT | 1092 | IPGFLRYRNRYYYGMDV |
| 183 | 1093 | SGSSSNIGNNYVS | 1094 | DNNKRPS | 1095 | GTWDSSLSAGV | 1096 | TSGMGVG | 1097 | LIDWDDNKYYTSLKT | 1098 | IPGFLRYRNRYYYGMDV |
| 184 | 1099 | SGSSSNIGDNYVS | 1100 | DNDKRPS | 1101 | GTWDSSLSAVV | 1102 | TSGMGVG | 1103 | LIDWDDNKYYTSLKT | 1104 | IPGFLRYRNRYYYGMDV |
| 185 | 1105 | SGSSSNIGNNYVS | 1106 | DNNKRPS | 1107 | GTWDSSLSAGV | 1108 | TSGMGVG | 1109 | LIDWDDNKYYTSLKT | 1110 | IPGFLRYRNRYYYGMDV |
| 186 | 1111 | SGRSSNIGNNYVS | 1112 | DNNKRPS | 1113 | GTWDSSLSAGV | 1114 | TSGMGVG | 1115 | LIDWDDNKYYTSLKT | 1116 | IPGFLRYRNRYYYGMDV |
| 187 | 1117 | SGSSSNIGNNYVS | 1118 | DNNKRPS | 1119 | GTWDSSLSAGV | 1120 | TSGVGVG | 1121 | LIDWDDNKYYTSLKT | 1122 | IPGFLRYRNRYYYGMDV |
| 188 | 1123 | SGSSSNIGNNYVS | 1124 | DNNKRPS | 1125 | GTWDSSLSAGV | 1126 | TSGMGVG | 1127 | LIDWDDNKYYTSLKT | 1128 | IPGFLRYRNRYYYGMDV |
| 189 | 1129 | SGRSSNIGNNYVS | 1130 | DNNKRPS | 1131 | GTWDSSLSAGV | 1132 | TSGMGVG | 1133 | LIDWDDNKYYTSLKT | 1134 | IPGFLRYRNRYYYGMDV |
| 190 | 1135 | SGSSSNIGNNYVS | 1136 | DNNKRPS | 1137 | GTWDSSLSAGV | 1138 | TSGVGVG | 1139 | LIDWDDNKYYTSLKT | 1140 | IPGFLRYRNRYYYGMDV |
| 191 | 1141 | SGSSSNIGNNYVS | 1142 | DNNKRPS | 1143 | GTWDSSLSAGV | 1144 | TSGMGVG | 1145 | LIDWDDNKYYTSLKT | 1146 | IPGFLRYRNRYYYGMDV |

TABLE 1-continued

| No. | SEQ ID | LC CDR1 | SEQ ID | LC CDR2 | SEQ ID | LC CDR3 | SEQ ID | HC CDR1 | SEQ ID | HC CDR2 | SEQ ID | HC CDR3 |
|---|---|---|---|---|---|---|---|---|---|---|---|---|
| 192 | 1147 | SGSSSNIGNNYVS | 1148 | DNNKRPS | 1149 | GTWDSSLSAGV | 1150 | TSGMGVG | 1151 | LIDWDDNKYYTSLKT | 1152 | IPGFLRYRNRYYYGMDV |
| 193 | 1153 | SGSSSNIGNNYVS | 1154 | DNNKRPS | 1155 | GTWDSSLSAGV | 1156 | TSGMGVG | 1157 | LIDWDDNKYYTSLKT | 1158 | IPGFLRYRNRYYYGMDV |
| 194 | 1159 | SGSSSNIGNNYVS | 1160 | DNNKRPS | 1161 | GTWDSSLSAGV | 1162 | TSGMGVG | 1163 | LIDWDDNKYYTSLKT | 1164 | IPGFLRYRNRYYYGMDV |
| 195 | 1165 | TRSSGSIASNYVQ | 1166 | EDNQRPS | 1167 | QSYDSSDWV | 1168 | RYGIS | 1169 | WISAYNGNTKYAQKLQG | 1170 | VLGIAVAGTPI |
| 196 | 1171 | TGSSSNIGAGYDVH | 1172 | GNSNRPS | 1173 | QSYDSSLSGSV | 1174 | SYAIS | 1175 | RIIPILGIANYAQKFQG | 1176 | VRGYSGYGSTYYFDY |
| 197 | 1177 | TGSSSNIGAGYDVH | 1178 | GNSNRPS | 1179 | QSYDSSLSGSI | 1180 | SYAIS | 1181 | GIIPILGIANYAQKFQG | 1182 | VRGYSGYGSTYYFDY |
| 198 | 1183 | TGSSSNIGAGYDVH | 1184 | GNSNRPS | 1185 | QSYDSSLSGSV | 1186 | SYAIS | 1187 | RIIPILGIANYAQKFQG | 1188 | VRGYSGYGSTYYFDY |
| 199 | 1189 | TGSSSNIGAGYDVH | 1190 | GNSNRPS | 1191 | QSYDSSLSGSI | 1192 | SYAIS | 1193 | GIIPILGIANYAQKFQG | 1194 | VRGYSGYGSTYYFDY |
| 200 | 1195 | TGSSSNIGAGYDVH | 1196 | GNSNRPS | 1197 | QSYDSSLSGSV | 1198 | SYAIS | 1199 | RIIPILGIANYAQKFQG | 1200 | VRGYSGYGSTYYFDY |
| 201 | 1201 | TGSSSNIGAGYDVH | 1202 | GNSNRPS | 1203 | QSYDSSLSGSV | 1204 | SYAIS | 1205 | RIIPILGIANYAQKFQG | 1206 | VRGYSGYGSTYYSDY |
| 202 | 1207 | TGSSSNIGAGYDVH | 1208 | GNSNRPS | 1209 | QSYDSSLSGSV | 1210 | SYAIS | 1211 | RIIPILGIANYAQKFQG | 1212 | VRGYSGYGSTYYSDY |
| 203 | 1213 | SGSSSNIGSNTVN | 1214 | SNNQRPS | 1215 | AAWDDSLNGYV | 1216 | RFAMH | 1217 | VVSYDGSNNYYADSVKG | 1218 | GDYYGSGSYYNPSPFFDY |
| 204 | 1219 | SGSSSNIGSKTVN | 1220 | SNNQRPS | 1221 | ATWDDSLNGWV | 1222 | RFAMH | 1223 | VVSYDGSNNYYADSVKG | 1224 | GDYYGSGSYYNPSPFFDY |

TABLE 1-continued

| No. | SEQ: ID | LC CDR1 | SEQ: ID | LC CDR2 | SEQ: ID | LC CDR3 | SEQ: ID | HC CDR1 | SEQ: ID | HC CDR2 | SEQ: ID | HC CDR3 |
|---|---|---|---|---|---|---|---|---|---|---|---|---|
| 205 | 1225 | SGSSSNIGSNTVN | 1226 | SNNQRPS | 1227 | ATWDDSLNGWV | 1228 | SFAMH | 1229 | VISFDGSNKYYADSVKG | 1230 | GDYYGSGSYYNPSPFFDY |
| 206 | 1231 | SGSSSNIGSNTVN | 1232 | SNNQRPS | 1233 | AAWDDSLNGWV | 1234 | NFAMH | 1235 | VISYDGSNKYYADSVKG | 1236 | GDYYGSGSYYNPSPFFDY |
| 207 | 1237 | SGSSSNIGSNTVN | 1238 | SNNQRPS | 1239 | ATWDDALSGWV | 1240 | RFAMH | 1241 | VVSYDGSNNYYADSVKG | 1242 | GDYYGSGSYYNPSPFFDY |
| 208 | 1243 | SGSSSNIGSNTVN | 1244 | SNNQRPS | 1245 | AAWDDSLNGWV | 1246 | RFAMH | 1247 | VVSYDGSNNYYADSVKG | 1248 | GDYYGSGSYYNPSPFFDY |
| 209 | 1249 | SGSSSNIGSKAVN | 1250 | SNNQRPS | 1251 | ATWDDSLNGWV | 1252 | SFAMH | 1253 | VISYDGSNKYYADSVKG | 1254 | GDYYGSGSYYNPSPFFDY |
| 210 | 1255 | SGSSSNIGSNTVN | 1256 | SNNQRPS | 1257 | AAWDDSLNGWV | 1258 | RFAMH | 1259 | VVSYDGSNNYYADSVKG | 1260 | GDYYGSGSYYNPSPFFDY |
| 211 | 1261 | SGSRSNIGGNTVN | 1262 | GDNQRPS | 1263 | AAWDDSLSGWV | 1264 | TYSMH | 1265 | VISYDGSNKYYADSVKG | 1266 | GDYYGSGSYYNPSPFFDY |
| 212 | 1267 | SGSSSNIGSNTVN | 1268 | SNNQRPS | 1269 | AAWEDSLNGYV | 1270 | NFAMH | 1271 | VISYDGSNKYYADSVKG | 1272 | GDYYGSGSYYNPSPFFDY |
| 213 | 1273 | SGSSSNIGSNTVN | 1274 | SNNQRPS | 1275 | AAWDDSLSGWV | 1276 | RFAMH | 1277 | VVSYDGSNNYYADSVKG | 1278 | GDYYGSGSYYNPSPFFDY |
| 214 | 1279 | SGSSSNIGSNTVN | 1280 | SNNQRPS | 1281 | ATWDDTLDSWV | 1282 | NFAMH | 1283 | VISYDGSNKYYADSVKG | 1284 | GDYYGSGSYYNPSPFFDY |
| 215 | 1285 | SGSSSNIGSNTVN | 1286 | SNNQRPS | 1287 | AAWDDSLNGYV | 1288 | SFAMH | 1289 | VISFDGSNKYYADSVKG | 1290 | GDYYGSGSYYNPSPFFDY |
| 216 | 1291 | SGSSSNIGSNTVN | 1292 | SNNQRPS | 1293 | AAWDDSLNGWV | 1294 | SFAMH | 1295 | VISYDGSNKYYADSVKG | 1296 | GDYYGSGSYYNPSPFFDY |

TABLE 1-continued

| No. | SEQ: ID | LC CDR1 | SEQ: ID | LC CDR2 | SEQ: ID | LC CDR3 | SEQ: ID | HC CDR1 | SEQ: ID | HC CDR2 | SEQ: ID | HC CDR3 |
|---|---|---|---|---|---|---|---|---|---|---|---|---|
| 217 | 1297 | SGSSSNIGSNTVN | 1298 | SNNQRPS | 1299 | AAWDDSLNVWV | 1300 | RFAMH | 1301 | VVSYDGSNNYYADSVKG | 1302 | GDYYGSGSYYNPSPFFDY |
| 218 | 1303 | SGSTSNIGSNPVN | 1304 | SNNQRPS | 1305 | AAWDDSLNGWV | 1306 | SFAMH | 1307 | VISFDGSNKYYADSVKG | 1308 | GDYYGSGSYYNPSPFFDY |
| 219 | 1309 | SGSSSNIGSNTVN | 1310 | SNSQRPS | 1311 | AGWDDSLNGWV | 1312 | RFAMH | 1313 | VVSYDGSNNYYADSVKG | 1314 | GDYYGSGSYYNPSPFFDY |
| 220 | 1315 | SGSSSNIGSNTVN | 1316 | SNNQRPS | 1317 | AAWDDSLNGWV | 1318 | NFAMH | 1319 | VISYDGSNKYFADSVKG | 1320 | GDYYGSGSYYNPSPFFDY |
| 221 | 1321 | SGSSSNIGSNTVN | 1322 | SNNQRPS | 1323 | ATWDDSLSGWV | 1324 | RFAMH | 1325 | VVSYDGSNNYYADSVKG | 1326 | GDYYGSGSYYNPSPFFDY |
| 222 | 1327 | SGSSSNIGSNTVN | 1328 | SNNQRPS | 1329 | ATWDDALSGWV | 1330 | RFAMH | 1331 | VVSYDGSNNYYADSVKG | 1332 | GDYYGSGSYYNPSPFFDY |
| 223 | 1333 | SGSSSNIGSNTVN | 1334 | SNNQRPS | 1335 | AAWDDSLNGWV | 1336 | RFAMH | 1337 | VVSYDGSNNYYADSVKG | 1338 | GDYYGSGSYYNPSPFFDY |
| 224 | 1339 | SGSSSNIGSNTVN | 1340 | SNNQRPS | 1341 | ATWDSSLSAWV | 1342 | SYSMH | 1343 | VISYDGSNKYYADSVKG | 1344 | GDYYGSGSYYNPSPFFDY |
| 225 | 1345 | SGSSSNIGSNTVN | 1346 | SNNQRPS | 1347 | AAWDDSLNGWV | 1348 | TYSMH | 1349 | VISYDGSNKYYADSVKG | 1350 | GDYYGSGSYYNPSPFFDY |
| 226 | 1351 | SGSSSNIGSNTVN | 1352 | SNNQRPS | 1353 | AAWDDSLNGWV | 1354 | NFAMH | 1355 | VISYDGSNKYFADSVKG | 1356 | GDYYGSGSYYNPSPFFDY |
| 227 | 1357 | SGSSSNIGSNTVN | 1358 | SNNQRPS | 1359 | AAWDDSLNGWV | 1360 | NFAMH | 1361 | VISYDGSNKYYADSVKG | 1362 | GDYYGSGSYYNPSPFFDY |
| 228 | 1363 | SGSSSNVGSNTVN | 1364 | SNDQRPS | 1365 | ATWDDSLNGWV | 1366 | SFAMH | 1367 | VISFDGSNKYYADSVKG | 1368 | GDYYGSGSYYNPSPFFDY |

TABLE 1-continued

| No. | SEQ: ID | LC CDR1 | SEQ: ID | LC CDR2 | SEQ: ID | LC CDR3 | SEQ: ID | HC CDR1 | SEQ: ID | HC CDR2 | SEQ: ID | HC CDR3 |
|---|---|---|---|---|---|---|---|---|---|---|---|---|
| 229 | 1369 | SGSSSNIGSNTVN | 1370 | SNNQRPS | 1371 | AAWDDSLSGWV | 1372 | RFAMH | 1373 | VVSYDGSNNYYADSVKG | 1374 | GDYYGSGSYYNPSPFFDY |
| 230 | 1375 | SGSSSNIGSNTVN | 1376 | SSNQRPS | 1377 | AAWDDSLNGWV | 1378 | NFAMH | 1379 | VISYDGSNKYYADSVKG | 1380 | GDYYGSGSYYNPSPFFDY |
| 231 | 1381 | SGSSSNIGSNTVN | 1382 | SNNQRPS | 1383 | ATWDDSLNGWV | 1384 | SFAMH | 1385 | VISFDGSNKYYADSVKG | 1386 | GDYYGSGSYYNPSPFFDY |
| 232 | 1387 | SGSSSNIGSNTVN | 1388 | SNNQRPS | 1389 | AAWDDSLNAWV | 1390 | SYSMH | 1391 | VISYDGSNKYYADSVKG | 1392 | GDYYGSGSYYNPSPFFDY |
| 233 | 1393 | SGSSSNIGSNTVN | 1394 | SNNQRPS | 1395 | AAWDDSLNGYV | 1396 | RFAMH | 1397 | VVSYDGSNNYYADSVKG | 1398 | GDYYGSGSYYNPSPFFDY |
| 234 | 1399 | SGSSSNIGSNTVN | 1400 | SNNQRPS | 1401 | AAWDDSLNGYV | 1402 | RFAMH | 1403 | VVSYDGSNNYYADSVKG | 1404 | GDYYGSGSYYNPSPFFDY |
| 235 | 1405 | SGSSSNIGSNTVN | 1406 | SNNQRPS | 1407 | AAWDDSLNGYV | 1408 | SYAMH | 1409 | VISFDGSNKYYADSVKG | 1410 | GDYYGSGSYYNPSPFFDY |
| 236 | 1411 | SGSSSNIGSNTVN | 1412 | SNNQRPS | 1413 | GTWDSNSETWV | 1414 | TYSMH | 1415 | VISYDGSNKYYADSVKG | 1416 | GDYYGSGSYYNPSPFFDY |
| 237 | 1417 | SGSNSNIGSNTVN | 1418 | SNNQRPS | 1419 | AAWDDSLNGYV | 1420 | SFAMH | 1421 | VISYDGSNKYYADSVKG | 1422 | GDYYGSGSYYNPSPFFDY |
| 238 | 1423 | SGSSSNIGSNTVN | 1424 | SNNQRPS | 1425 | AAWDDSLNGWV | 1426 | TYSMH | 1427 | VISYDGSNKYYADSVKG | 1428 | GDYYGSGSYYNPSPFFDY |
| 239 | 1429 | SGSSSNIGSKTVN | 1430 | SNNQRPS | 1431 | AAWDDSLSGWV | 1432 | NFAMH | 1433 | VISYDGSNKYYADSVKG | 1434 | GDYYGSGSYYNPSPFFDY |
| 240 | 1435 | SGSSSNIGSNTVN | 1436 | SNNQRPS | 1437 | AAWDDSLSGWV | 1438 | NFAMH | 1439 | VISYDGSNKYYADSVKG | 1440 | GDYYGSGSYYNPSPFFDY |

TABLE 1-continued

| No. | SEQ: ID | LC CDR1 | SEQ: ID | LC CDR2 | SEQ: ID | LC CDR3 | SEQ: ID | HC CDR1 | SEQ: ID | HC CDR2 | SEQ: ID | HC CDR3 |
|---|---|---|---|---|---|---|---|---|---|---|---|---|
| 241 | 1441 | SGSSSNIGINSVN | 1442 | SNNQRPS | 1443 | AAWDDSLNGYV | 1444 | SFAMH | 1445 | VISYDGSNKYYADSVKG | 1446 | GDYYGSGSYYNPSPFFDY |
| 242 | 1447 | SGSSSNIGSKTVN | 1448 | SNNQRPS | 1449 | ATWDDSLNGWV | 1450 | SFAMH | 1451 | VISYDGSNKYYAESVKG | 1452 | GDYYGSGSYYNPSPFFDY |
| 243 | 1453 | SGSSSNIGSNTVN | 1454 | SNNQRPS | 1455 | AAWDDSLSGWV | 1456 | SFAMH | 1457 | VISYDGSNKYYADSVKG | 1458 | GDYYGSGSYYNPSPFFDY |
| 244 | 1459 | SGSSSNIGSNTVN | 1460 | SNNQRPS | 1461 | AAWDDSLNGYV | 1462 | NFAMH | 1463 | VISYDGSNKYYADSVKG | 1464 | GDYYGSGSYYNPSPFFDY |
| 245 | 1465 | SGSSSNIGSNTVN | 1466 | SNNQRPS | 1467 | ATWDDSLNAWV | 1468 | RFAMH | 1469 | VVSYDGSNNYYADSVKG | 1470 | GDYYGSGSYYNPSPFFDY |
| 246 | 1471 | SGSSSNIGSNTVN | 1472 | SNNQRPS | 1473 | ATWDDSLNGYV | 1474 | RFAMH | 1475 | VVSYDGSNNYYADSVKG | 1476 | GDYYGSGSYYNPSPFFDY |
| 247 | 1477 | SGSSSNIGSNTVN | 1478 | SNQRPS | 1479 | AAWDDSLSGWV | 1480 | RFAMH | 1481 | VVSYDGSNNYYADSVKG | 1482 | GDYYGSGSYYNPSPFFDY |
| 248 | 1483 | SGSSSNIGNNYVS | 1484 | DNNKRPS | 1485 | GTWDSSLSAVV | 1486 | TSGVGVG | 1487 | LIDWDDNKYYTSLKT | 1488 | IPGFLRYRNRYYYGMDV |
| 249 | 1489 | GGNNIGSKSVH | 1490 | YDSDRPS | 1491 | QVWDGSSDHYV | 1492 | SYAMS | 1493 | AISGSGGSTYYADSVKG | 1494 | LSHGVVGAQDAFDI |
| 250 | 1495 | TGSSSNIGAGYDVH | 1496 | GNSNRPS | 1497 | QSYDSSLSGSV | 1498 | SYAIS | 1499 | RIIPILGIANYAQKFQG | 1500 | EEATTGINTNWFDP |
| 251 | 1501 | SGSSSNIGSNTVN | 1502 | SNNQRPS | 1503 | AAWDDSLNGVV | 1504 | DYAMH | 1505 | GIDWNSGLIGYADAVKG | 1506 | DMGSTGGYYGMDV |
| 252 | 1507 | SGSSSNIGSNTVN | 1508 | SNNQRPS | 1509 | AAWDDSLNGPVV | 1510 | DYAMH | 1511 | GIDWNSGLIGYADAVKG | 1512 | DMGSTGGYYGMDV |

TABLE 1-continued

| No. | SEQ: ID | LC CDR1 | SEQ: ID | LC CDR2 | SEQ: ID | LC CDR3 | SEQ: ID | HC CDR1 | SEQ: ID | HC CDR2 | SEQ: ID | HC CDR3 |
|---|---|---|---|---|---|---|---|---|---|---|---|---|
| 253 | 1513 | SGSSSNIGSNTVN | 1514 | SNNQRPS | 1515 | AAWDDSLNGVV | 1516 | DYAMH | 1517 | GIDWNSGLIGYADAVKG | 1518 | DMGSTGGYYGMDV |
| 254 | 1519 | GGNNIGSKSVH | 1520 | YDSDRPS | 1521 | QVWDSSSDHPV | 1522 | DYAMH | 1523 | GIDWNSGLIGYADAVKG | 1524 | DMGSTGGYYGMDV |
| 255 | 1525 | TRSSGSIASNYVQ | 1526 | EDNQRPS | 1527 | QSYDSSNHAV | 1528 | DYAMH | 1529 | GIDWNSGLIGYADAVKG | 1530 | DMGSTGGYYGMDV |
| 256 | 1531 | SGSSSNIGNNYVS | 1532 | DNNKRPS | 1533 | GTWDSSLSAGV | 1534 | DYAMH | 1535 | GIDWNSGLIGYADAVKG | 1536 | DMGSTGGYYGMDV |
| 257 | 1537 | SGSSSNIGSNTVN | 1538 | SNNQRPS | 1539 | AAWDDSLNGVV | 1540 | DYAMH | 1541 | GIDWNSGLIGYADAVKG | 1542 | DMGSTGGYYGMDV |
| 258 | 1543 | SGSSSNIGNNYVS | 1544 | DNNKRPS | 1545 | GTWDSSLSAVV | 1546 | DYAMH | 1547 | GIDWNSGLIGYADAVKG | 1548 | DMGSTGGYYGMDV |
| 259 | 1549 | SGSSSNIGSNTVN | 1550 | SNNQRPS | 1551 | AAWDDSLNGVV | 1552 | DYAMH | 1553 | GIDWNSGLIGYADAVKG | 1554 | DMGSTGGYYGMDV |
| 260 | 1555 | SGSSSNIGSNTVN | 1556 | TNNQRPS | 1557 | AAWDDSLNGLV | 1558 | DYAMH | 1559 | GIDWNSGLIGYADAVKG | 1560 | DMGSTGGYYGMDV |
| 261 | 1561 | SGSSSNIGNNYVS | 1562 | DNDKRPS | 1563 | GTWDSSLSAYV | 1564 | DYAMH | 1565 | GIDWNSGLIGYADAVKG | 1566 | DMGSTGGYYGMDV |
| 262 | 1567 | SGSSSNIGSNTVN | 1568 | SNNQRPS | 1569 | QSYDSSLSGYV | 1570 | DYAMH | 1571 | GIDWNSGLIGYADAVKG | 1572 | DMGSTGGYYGMDV |
| 263 | 1573 | SGSSPNIGNNYVS | 1574 | DNNKRPS | 1575 | GTWDSSLSAYV | 1576 | DYAMH | 1577 | GIDWNSGLIGYADAVKG | 1578 | DMGSTGGYYGMDV |
| 264 | 1579 | SGSSSNIGNNYVS | 1580 | DNNKRPS | 1581 | GTWDSSLSAYV | 1582 | DYAMH | 1583 | GIDWNSGLIGYADAVKG | 1584 | DMGSTGGYYGMDV |

TABLE 1-continued

| No. | SEQ: ID | LC CDR1 | SEQ: ID | LC CDR2 | SEQ: ID | LC CDR3 | SEQ: ID | HC CDR1 | SEQ: ID | HC CDR2 | SEQ: ID | HC CDR3 |
|---|---|---|---|---|---|---|---|---|---|---|---|---|
| 265 | 1585 | TGSSSNIGAGYDVH | 1586 | GNSNRPS | 1587 | QSYDSSLSGV | 1588 | SNYMT | 1589 | VIYSGGSTFYADSVKG | 1590 | DLVVYGMDV |
| 266 | 1591 | GGNNIGSKSVH | 1592 | YDSDRPS | 1593 | QVRDSSSDHPV | 1594 | SNYMT | 1595 | VIYSGGSTFYADSVKG | 1596 | DLVVYGMDV |
| 267 | 1597 | TGSSSNIGAGYDVH | 1598 | GNSNRPS | 1599 | QSYDSSLSGV | 1600 | SNYMT | 1601 | VIYSGGSTFYADSVKG | 1602 | DLVVYGMDV |
| 268 | 1603 | TGSDSNIGAGYDVH | 1604 | NNNNRPS | 1605 | QSSDSGLTGWV | 1606 | SNYMT | 1607 | VIYSGGSTFYADSVKG | 1608 | DLVVYGMDV |
| 269 | 1609 | TGSSSNIGAGYDVH | 1610 | GNSNRPS | 1611 | QSYDSSLSGSV | 1612 | SNYMT | 1613 | VIYSGGSTFYADSVKG | 1614 | DLVVYGMDV |
| 270 | 1615 | RASQSVSSYLA | 1616 | DASNRAT | 1617 | QQYGSSPLT | 1618 | SNYMT | 1619 | VIYSGGSTFYADSVKG | 1620 | DLVVYGMDV |
| 271 | 1621 | SGSSSNIGSNTVN | 1622 | SNNQRPS | 1623 | SSYAGSNNLV | 1624 | SNYMT | 1625 | VIYSGGSTFYADSVKG | 1626 | DLVVYGMDV |
| 272 | 1627 | TGSSSNIGAGYDVH | 1628 | GNSNRPS | 1629 | QSYDSSLSGSV | 1630 | SNYMT | 1631 | VIYSGGSTFYADSVKG | 1632 | DLVVYGMDV |
| 273 | 1633 | RASQSVSSYLA | 1634 | DASNRAT | 1635 | QQYGSSPLT | 1636 | SNYMT | 1637 | VIYSGGSTFYADSVKG | 1638 | DLVVYGMDV |
| 274 | 1639 | TGSSSNIGAGYDVH | 1640 | GNSNRPS | 1641 | QSYDSSLGVV | 1642 | SNYMT | 1643 | VIYSGGSTFYADSVKG | 1644 | DLVVYGMDV |
| 275 | 1645 | GGNNIGSNTVN | 1646 | SNNLRPS | 1647 | AAWDDSLNGPV | 1648 | SNYMT | 1649 | VIYSGGSTFYADSVKG | 1650 | DLVVYGMDV |
| 276 | 1651 | SGSSSNIGSDVG | 1652 | KSNQRPS | 1653 | ATWDDRLNWV | 1654 | SNYMT | 1655 | VIYSGGSTFYADSVKG | 1656 | DLVVYGMDV |
| 277 | 1657 | RASQSISSYLN | 1658 | AASSLQS | 1659 | QQSYSTPFT | 1660 | NYYMH | 1661 | IINPSGGSTSYAQKFQG | 1662 | GGIAPYTRGAFDY |
| 278 | 1663 | QAGQDISNYLN | 1664 | KASSLES | 1665 | QQAHSFPFT | 1666 | SYYMH | 1667 | IINPSGGSTSYAQKFQG | 1668 | GGIAPYTRGAFDY |
| 279 | 1669 | QASQDISNYLN | 1670 | DASNLET | 1671 | QQSYSTLPT | 1672 | SYYMH | 1673 | IINPSGGSTSYAQKFQG | 1674 | GGIAPYTRGAFDY |

TABLE 1-continued

| No. | SEQ: ID | LC CDR1 | SEQ: ID | LC CDR2 | SEQ: ID | LC CDR3 | SEQ: ID | HC CDR1 | SEQ: ID | HC CDR2 | SEQ: ID | HC CDR3 |
|---|---|---|---|---|---|---|---|---|---|---|---|---|
| 280 | 1675 | TGSSSNTGAGYDVH | 1676 | SNNQRPS | 1677 | AAWDDSLNGGV | 1678 | SNYMS | 1679 | VIYSGGSTNYADSVKG | 1680 | DLIVYGMDV |
| 281 | 1681 | TGSSSNIGAGYDVH | 1682 | GNSNRPS | 1683 | AAWDDSLSGWV | 1684 | SNYMS | 1685 | VIYSGGSTNYADSVKG | 1686 | DLIVYGMDV |
| 282 | 1687 | SGSSSNIGAGYDVH | 1688 | GNSNRPS | 1689 | AAWDDSLNGGV | 1690 | SNYMS | 1691 | VIYSGGSTNYADSVKG | 1692 | DLIVYGMDV |
| 283 | 1693 | RASQSVSSYLA | 1694 | DASNRAT | 1695 | QQYGSSPPYT | 1696 | SNYMS | 1697 | VIYPGGSTYYADSVKG | 1698 | DLRGVLDY |
| 284 | 1699 | SGSSSNIGNNYVS | 1700 | DNNKRPS | 1701 | GTWDSSLSAGV | 1702 | SNYMS | 1703 | VIYSGGSTYYADSVKG | 1704 | GHVDIPYGMDV |
| 285 | 1705 | TGSSSNIGAGYDVH | 1706 | GNSNRPS | 1707 | QSYDSSLSGSV | 1708 | SYAIS | 1709 | RIIPILGIANYAQKFQG | 1710 | EKGYSGSGSVNWFDP |
| 286 | 1711 | TGSSSNIGAGYDVH | 1712 | GNSNRPS | 1713 | QSYDSSLSGSV | 1714 | SYAIS | 1715 | RIIPILGIANYAQKFQG | 1716 | EKGYSGSGSVNWFDP |
| 287 | 1717 | TGSSSNIGAGYDVH | 1718 | GNSNRPS | 1719 | QSYDSSLSGSV | 1720 | SYAIS | 1721 | RIIPILGIANYAQKFQG | 1722 | EEATTGINTNWFDP |
| 288 | 1723 | TRSSGSIASNYVQ | 1724 | EDNQRPS | 1725 | QSYDSSNHWV | 1726 | SYAMH | 1727 | VISYDGSNKYYADSVKG | 1728 | ANLGYCTNGVCAPSGG |
| 289 | 1729 | SGGSSNIGNNYVS | 1730 | DNNKRPS | 1731 | GTWDSSLSAWV | 1732 | DYAMH | 1733 | GISWNSGRIGYADSVKG | 1734 | NLRYFDWLLGDDAFDI |
| 290 | 1735 | TGSSSNIGAGYDVH | 1736 | GNSNRPS | 1737 | QSYDSSLSGSV | 1738 | SNYMT | 1739 | VIYSGGSTFYADSVKG | 1740 | DLVVYGMDV |

In the present invention, CDRs of variable regions were determined through a typical method using a system devised by Kabat et al. (Kabat et al., Sequences of Proteins of Immunological Interest (5$^{th}$), National Institutes of Health, Bethesda, MD (1991)). The CDR numbering used in the present invention is determined using the Kabat method, but the present invention also encompasses binding molecules comprising CDRs determined through other methods such as an IMGT method, Chothia method, AbM method and the like. For example, as shown in Table 2 below, as binding molecules comprising three light-chain CDR regions (LC CDR1, LC CDR2, and LC CDR3) contained in the light-chain region (LC) variable and three heavy-chain CDR regions (HC CDR1, HC CDR2, and HC CDR3) contained in the heavy-chain (HC) variable region, binding molecules comprising CDRs determined through a Kabat method, an IMGT method, a Chothia method and/or an AbM method are included within the scope of the present invention. In addition, for example, as binding molecules comprising three light-chain CDR regions (LC CDR1, LC CDR2, and LC CDR3) and three heavy-chain CDR regions (HC CDR1, HC CDR2, and HC CDR3) contained in the light-chain (LC)

variable regions and/or the heavy-chain (HC) variable regions of SEQ ID NOS: 1741 to 2320, binding molecules comprising CDRs determined through a Kabat method, an IMGT method, a Chothia method and/or an AbM method are included within the scope of the present invention.

In an embodiment of the present invention, the binding molecule may be any one selected from the group consisting of binding molecules shown in Table 2 below, or may be a binding molecule comprising these sequences. In Table 2 below, No. means each binding molecule number.

Also, in another embodiment of the present invention, the binding molecule may be any one selected from the group consisting of binding molecule Nos. 1, 2, 3, 4, 6, 7, 8, 9, 13, 14, 31, 44, 46, 47, 48, 49, 53, 55, 56, 65, 66, 69, 70, 71, 72, 79, 81, 83, 86, 88, 89, 90, 91, 93, 95, 103, 108, 113, 118, 128, 129, 139, 152, 195, 196, 197, 201, 203, 204, 205, 206, 207, 208, 209, 212, 213, 214, 215, 216, 217, 218, 219, 220, 221, 224, 230, 232, 235, 236, 239, 241, 242, 243, 244, 245, 246, 247, 249, 250, 251, 252, 254, 256, 259, 260, 261, 263, 265, 266, 268, 270, 271, 274, 275, 276, 278, 279, 280, 281, 283, 284, 285, 287, 288, 289 and 290 among the binding molecules shown in Table 2 below, or may be a binding molecule comprising the same.

Also, in another embodiment of the present invention, the binding molecule may be any one selected from the group consisting of binding molecule Nos. 89, 90, 91, 93, 95, 103, 108, 113, 118, 128, 129, 139, 152, 217, 218, 230, 260, 270, 271, 274, 275, 281 and 284 among the binding molecules shown in Table 2 below, or may be a binding molecule comprising the same.

Also, in another embodiment of the present invention, the binding molecule may be any one selected from the group consisting of binding molecule Nos. 91, 93, 103, 129, 139, 217, 260, 270, 275 and 284 among the binding molecules shown in Table 2 below, or may be a binding molecule comprising the same.

Also, in another embodiment of the present invention, the binding molecule may be any one selected from the group consisting of binding molecule Nos. 91, 93, 103, 129, 139 and 260 among the binding molecules shown in Table 2 below, or may be a binding molecule comprising the same.

Also, in another embodiment of the present invention, the binding molecule may be any one selected from the group consisting of binding molecule Nos. 91, 93, 103, 129 and 139 among the binding molecules shown in Table 2 below, or may be a binding molecule comprising the same.

Also, in another embodiment of the present invention, the binding molecule may be a binding molecule of No. 139 among the binding molecules shown in Table 2 below, or may be a binding molecule comprising the same.

TABLE 2

| No. | SEQ: ID | LC variable region | SEQ: ID | HC variable region |
|---|---|---|---|---|
| 1 | 1741 | ELQMTQSPSSLSASVGDRVTI TCRASQSISSYLNWYQQKPG KAPKLLIYAASSLQSGVPSRF SGSGSGTDFTLTISSLQPEDF ATYYCQQSYSTPFTFGPGTK VDIK | 1742 | EVQLLESGGGLVQPGRSLRL SCAASGFTFGDYAMHWVRQ APGKGLEWVSGISWNSGRIG YADSVKGRFTISRDNAKNSL YLQMNSLRAEDTALYYCAK GDCGGDCYSFLLGEDAFDIW GQGTMVTVSS |
| 2 | 1743 | ELQMTQSPSSLSASVGDRVTI TCRASQSISTYLNWYQQKVG KAPKLLIYAASSLQSGVPSRF SGRGSGTDFTLTISSLQPEDF ATYYCQQSYSIPHTFGQGTK LEIK | 1744 | EVQLLESGGGLVQPGRSLRL SCAASGFTFGDYAMHWVRQ APGKGLEWVSGISWNSGRIG YADSVKGRFTISRDNAKNSL YLQMNSLRAEDTALYYCAK GDCGGDCYSFLLGEDAFDIW GQGTMVTVSS |
| 3 | 1745 | ELVMTQSPSSLSASVGDRVTI TCQASQDISNYLNWYQQKPG KAPKLLIYDASNLETGVPSRF SGSGSGTDFTFTISSLQPEDIA TYYCQQYDNLPITFGQGTRL EIK | 1746 | EVOLVESGGGVVQPGRSLRL SCAASGFTFSSYAMSWVRQA PGKGLEWVSAISGSGGSTYY ADSVKGRFTISRDNSKNTLY LQMNSLRAEDTAVYYCAKS LVSGRYCSGVTCYSWFDPW GQGTLVTVSS |
| 4 | 1747 | ELVMTQSPSSLSASVGDRVTI TCQASQDISNYLNWYQQKPG KAPKLLIYDASNLETGVPSRF SGSGSGTDFTFTISSLQPEDIA TYYCQQYDDLPITFGQGTRL EIK | 1748 | EVQLVQSGGGLVQPGGSLRL SCAASGFTFSSYAMSWVRQA PGKGLEWVSAISGSGGSTYY ADSVKGRFTISRDNSKNTLY LQMNSLRAEDTAVYYCAKS LVSGRYCSGVTCYSWFDPW GQGTLVTVSS |
| 5 | 1749 | ELVMTQSPSSLSASVGDRVTI TCQASQDISNYLNWYQQKPG KAPKLLIYDASNLETGVPSRF SGSGSGTDFTFTISSLQPEDIA TYYCQQYDNLPITFGQGTRL EIK | 1750 | EVOLVESGGGVVQPGRSLRL SCAASGFTFSSYAMSWVRQA PGKGLEWVSAISGSGGSTYY ADSVKGRFTISRDNSKNTLY LQMNSLRAEDTAVYYCAKS LVSGRYCSGVTCYSWFDPW GQGTLVTVSS |
| 6 | 1751 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGKVF GGGTKVTVL | 1752 | EVQLVQSGAEVKKPGSSVKV SCKASGGTFSSYAISWVRQA PGQGLEWMGGIIPIFGTANY AQKFQDRVTITADESTSTAY MELSSLRSEDTAVYYCARDG VVVPAVMYDTTDPYYYGM DVWGQGTTVTVSS |

TABLE 2-continued

| No. | SEQ: ID | LC variable region | SEQ: ID | HC variable region |
|---|---|---|---|---|
| 7 | 1753 | ELELTQPPSVSGTPGQRVTISCSGSSSNIGSNYVYWYQQLPGTAPKLLIYRNNQRPPGVPDRFSGSKSGTSASLAISGLRSEDEADYYCAAWDDSLSGRVFGGGTELTVL | 1754 | EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDGVVVPAVMYDTTDPYYYGMDVWGQGTTVTVSS |
| 8 | 1755 | ELELTQPPSVSGTPGQRVTISCSGSSSNIGSNYVYWYQQLPGTAPKLLIYRNNQRPSGVPDRFSGSKSGTSASLAISGLRSEDEADYYCAAWDDSLSGRVFGGGTKVTVL | 1756 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDGVVVPAVMYDTTDPYYYGMDVWGQGTTVTVSS |
| 9 | 1757 | ELELTQPPSASGTPGQRVTISCSGSSSNIGSNYVYWYQQLPGTAPKLLIYRNNQRPSGVPDRFSGSKSGTSASLAISGLRSEDEADYYCAAWDDSLNGRVFGGGTKVTVL | 1758 | EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDGVVVPAVMYDTTDPYYYGMDVWGQGTTVTVSS |
| 10 | 1759 | ELVLTQSPSASGTPGQRVTISCSGSSSNIGSNYVYWYQQLPGTAPKLLIYRNNQRPSGVPDRFSGSKSGTSASLAISGLRSEDEADYYCAAWDDSLSGRVFGGGTKVTVL | 1760 | EVQLVQSGAEVKKPGSSVKVSCKASGGTFSSYAISWVRQAPGQGLEWMGGIIPIFGTENYAQKFQGRVTITADESTSTAYMELSSLRSEDTAVYYCARDGVVVPAVMYDTTDPYYYGMDVWGQGTTVTVSS |
| 11 | 1761 | ELVLTQSPSASGTPGQRVTISCSGSSSNIGSNYVYWYQQLPGTAPKLLIYRNNQRPSGVPDRFSGSKSGTSASLAISGLRSEDEADYYCAAWDDSLSGRVFGGGTKVTVL | 1762 | EVQLVQSGAEVKKPGSSVKVSCKASGGTFSSYAISWVRQAPGQGLEWMGGIIPIFGTENYAQKFQGRVTITADESTSTAYMELSSLRSEDTAVYYCARDGVVVPAVMYDTTDPYYYGMDVWGQGTTVTVSS |
| 12 | 1763 | ELELTQPPSVSGTPGQRVTISCSGSSSNIGSNYVYWYQQLPGTAPKLLIYRNNQRPSGVPDRFSGSKSGTSASLAISGLRSEDEADYYCAAWDDSLSGKVFGGGTKVTVL | 1764 | EVQLVQSGAEVKKPGSSVKVSCKASGGTFSSYAISWVRQAPGQGLEWMGGIIPIFGTANYAQKFQDRVTITADESTSTAYMELSSLRSEDTAVYYCARDGVVVPAVMYDTTDPYYYGMDVWGQGTTVTVSS |
| 13 | 1765 | ELVLTQPPSASGTPGQSVTISCSGSSSNIGNNYVYWYQQLPGTAPKLLIYGNYQRPSGVPDRFSGSKSGTSASLAISGLRSEDEADYYCAAWDDSLSGRVFGGGTKLTVL | 1766 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDGVVVPAVMYDTTDPYYYGMDVWGQGTTVTVSS |
| 14 | 1767 | ELELTQPPSVSGAPGQRVTISCSGSSSNIGGNYVHWYQQLPGAAPKLLIYSNDQRPSGVPDRFSGSKSGTSASLAISGLQSEDEADYYCAAWDDSLNGRVFGGGTQLTVL | 1768 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDGVVVPAVMYDTTDPYYYGMDVWGQGTTVTVSS |
| 15 | 1769 | ELELTQPPSVSGTPGQRVTISCSGSSSNIGSNYVYWYQQLPGTAPKLLIYRNNQRPPGVPDRFSGSKSGTSASLAISGLRSEDEADYYCAAWDDSLSGRVFGGGTELTVL | 1770 | EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDGVVVPAVMYDTTDPYYYGMDVWGQGTTVTVSS |
| 16 | 1771 | ELELTQPPSVSGTPGQRVTISCSGSSSNIGSNYVYWYQQLPGTAPKLLIYRNNQRPSGVPDRFSGSKSGTSASLAISGLRSEDEADYYCAAWDDSLSGKVFGGGTKVTVL | 1772 | EVQLVQSGAEVKKPGSSVKVSCKASGGTFSSYAISWVRQAPGQGLEWMGGIIPIFGTANYAQKFQDRVTITADESTSTAYMELSSLRSEDTAVYYCARDGVVVPAVMYDTTDPYYYGMDVWGQGTTVTVSS |
| 17 | 1773 | ELELTQPPSVSGTPGQRVTISCSGSSSNIGSNYVYWYQQLPGTAPKLLIYRNNQRPSGVPDRFSGSKSGTSASLAISGLRSEDEADYYCAAWDDSLSGKVFGGGTKVTVL | 1774 | EVQLVQSGAEVKKPGSSVKVSCKASGGTFSSYAISWVRQAPGQGLEWMGGIIPIFGTANYAQKFQDRVTITADESTSTAYMELSSLRSEDTAVYYCARDGVVVPAVMYDTTDPYYYGMDVWGQGTTVTVSS |

TABLE 2-continued

| No. | SEQ: ID | LC variable region | SEQ: ID | HC variable region |
|---|---|---|---|---|
| 18 | 1775 | ELVLTQPPSVSGAPGQRVTIS CTGSSSNIGAGYDVHWYQQL PGTAPKLLIYGNSNRPSGVPD RFSGSKSGTSASLAITGLQAE DEADYYCQSYDSSLSGKVFG GGTKVTVL | 1776 | QVQLVQSGAEVKKPGASVK VSCKASGGTFSSYAISWVRQ APGQGLEWMGGIIPIFGTAN YAQKFQGRVTITADESTSTA YMELSSLRSEDTAVYYCARD GVVVPAVMYDTTDPYYYG MDVWGQGTTVTVSS |
| 19 | 1777 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGRVF GGGTKLTVL | 1778 | QVQLVQSGAEVKKPGSSVK VSCKASGGTFSSYAISWVRQ APGQGLEWMGGIIPIFGTAN YAQKFQGRVTITADESTSTA YMELSSLRSEDTAVYYCARD GVVVPAVMYDTTDPYYYG MDVWGQGTTVTVSS |
| 20 | 1779 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGKVF GGGTKVTVL | 1780 | EVQLVQSGAEVKKPGSSVKV SCKASGGTFSSYAISWVRQA PGQGLEWMGGIIPIFGTANY AQKFQDRVTITADESTSTAY MELSSLRSEDTAVYYCARDG VVVPAVMYDTTDPYYYGM DVWGQGTTVTVSS |
| 21 | 1781 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGKVF GGGTKVTVL | 1782 | EVQLVQSGAEVKKPGSSVKV SCKASGGTFSSYAISWVRQA PGQGLEWMGGIIPIFGTANY AQKFQDRVTITADESTSTAY MELSSLRSEDTAVYYCARDG VVVPAVMYDTTDPYYYGM DVWGQGTTVTVSS |
| 22 | 1783 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGKVF GGGTKVTVL | 1784 | EVQLVQSGAEVKKPGSSVKV SCKASGGTFSSYAISWVRQA PGQGLEWMGGIIPIFGTANY AQKFQDRVTITADESTSTAY MELSSLRSEDTAVYYCARDG VVVPAVMYDTTDPYYYGM DVWGQGTTVTVSS |
| 23 | 1785 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGKVF GGGTKVTVL | 1786 | EVQLVQSGAEVKKPGSSVKV SCKASGGTFSSYAISWVRQA PGQGLEWMGGIIPIFGTANY AQKFQDRVTITADESTSTAY MELSSLRSEDTAVYYCARDG VVVPAVMYDTTDPYYYGM DVWGQGTTVTVSS |
| 24 | 1787 | ELELTQPPSVSGTPGQRVTIS CSGSSSNIGSNYVYWYQQLP GTAPKLLIYRNNQRPPGVPD RFSGSKSGTSASLAISGLRSE DEADYYCAAWDDSLSGRVF GGGTELTVL | 1788 | EVQLVQSGAEVKKPGSSVKV SCKASGGTFSSYAISWVRQA PGQGLEWMGGIIPIFGTANY AQKFQGRVTITADESTSTAY MELSSLRSEDTAVYYCARDG VVVPAVMYDTTDPYYYGM DVWGQGTTVTVSS |
| 25 | 1789 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGKVF GGGTKVTVL | 1790 | EVQLVQSGAEVKKPGSSVKV SCKASGGTFSSYAISWVRQA PGQGLEWMGGIIPIFGTANY AQKFQDRVTITADESTSTAY MELSSLRSEDTAVYYCARDG VVVPAVMYDTTDPYYYGM DVWGQGTTVTVSS |
| 26 | 1791 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGKVF GGGTKVTVL | 1792 | EVQLVQSGAEVKKPGSSVKV SCKASGGTFSSYAISWVRQA PGQGLEWMGGIIPIFGTANY AQKFQDRVTITADESTSTAY MELSSLRSEDTAVYYCARDG VVVPAVMYDTTDPYYYGM DVWGQGTTVTVSS |
| 27 | 1793 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGKVF GGGTKVTVL | 1794 | EVQLVQSGAEVKKPGSSVKV SCKASGGTFSSYAISWVRQA PGQGLEWMGGIIPIFGTANY AQKFQDRVTITADESTSTAY MELSSLRSEDTAVYYCARDG VVVPAVMYDTTDPYYYGM DVWGQGTTVTVSS |
| 28 | 1795 | ELELTQPPSASGTPGQRVTIS CSGSSSNIGSNYVYWYQQLP GTAPKLLIYRNNQRPSGVPD RFSGSKSGTSASLAISGLRSE DEADYYCAAWDDSLNGRVF GGGTKVTVL | 1796 | EVQLVQSGAEVKKPGSSVKV SCKASGGTFSSYAISWVRQA PGQGLEWMGGIIPIFGTANY AQKFQGRVTITADESTSTAY MELSSLRSEDTAVYYCARDG VVVPAVMYDTTDPYYYGM DVWGQGTTVTVSS |

TABLE 2-continued

| No. | SEQ: ID | LC variable region | SEQ: ID | HC variable region |
|---|---|---|---|---|
| 29 | 1797 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGKVF GGGTKVTVL | 1798 | EVQLVQSGAEVKKPGSSVKV SCKASGGTFSSYAISWVRQA PGQGLEWMGGIIPIFGTANY AQKFQDRVTITADESTSTAY MELSSLRSEDTAVYYCARDG VVVPAVMYDTTDPYYYGM DVWGQGTTVTVSS |
| 30 | 1799 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGKVF GGGTKVTVL | 1800 | EVQLVQSGAEVKKPGSSVKV SCKASGGTFSSYAISWVRQA PGQGLEWMGGIIPIFGTANY AQKFQDRVTITADESTSTAY MELSSLRSEDTAVYYCARDG VVVPAVMYDTTDPYYYGM DVWGQGTTVTVSS |
| 31 | 1801 | ELGLTQPPSVSGTPGQRVTIS CSGSSSNIGGNYVHWYQQLP GAAPKLLIYSNDQRPSGVPD RFSGSKSGTSASLAISGLQSE DEADYYCAAWDDSLSGRVF GGGTKLTVL | 1802 | QVQLVQSGAEVKKPGSSVK VSCKASGGTFSSYAISWVRR APGQGLEWMGGIIPIFGTAN YAQKFQGRVTITADESTSTA YMELSSLRSEDTAVYYCARD GVVVPAVMYDTTDPYYYG MDVWGQGTTVTVSS |
| 32 | 1803 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGKVF GGGTKVTVL | 1804 | EVQLVQSGAEVKKPGSSVKV SCKASGGTFSSYAISWVRQA PGQGLEWMGGIIPIFGTANY AQKFQDRVTITADESTSTAY MELSSLRSEDTAVYYCARDG VVVPAVMYDTTDPYYYGM DVWGQGTTVTVSS |
| 33 | 1805 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGKVF GGGTKVTVL | 1806 | EVQLVQSGAEVKKPGSSVKV SCKASGGTFSSYAISWVRQA PGQGLEWMGGIIPIFGTANY AQKFQDRVTITADESTSTAY MELSSLRSEDTAVYYCARDG VVVPAVMYDTTDPYYYGM DVWGQGTTVTVSS |
| 34 | 1807 | ELVLTQSPSASGTPGQRVTIS CSGSSSNIGSNYVYWYQQLP GTAPKLLIYRNNQRPSGVPD RFSGSKSGTSASLAISGLRSE DEADYYCAAWDDSLSGRVF GGGTKLTVL | 1808 | QVQLVQSGAEVKKPGSSVK VSCKASGGTFSSYAISWVRQ APGQGLEWMGGIIPIFGTAN YAQKFQGRVTITTDESTSTA YMELSRSEDTAVYYCARD GVVVPAVMYDTTDPYYYG MDVWGQGTTVTVSS |
| 35 | 1809 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGRVF GGGTKVTVL | 1810 | QVQLVQSGAEVKKPGSSVK VSCKASGGTFSSYAISWVRQ APGQGLEWMGGIIPIFGTAN YAQKFQGRVTITADESTSTA YMELSSLRSEDTAVYYCARD GVVVPAVMYDTTDPYYYG MDVWGQGTTVTVSS |
| 36 | 1811 | ELVVTQPPSASGAPGQRVTIS CSGGSSNIGSNYVYWYQQLP GTAPKLLIYRNNQRPSGVPD RFSGSKSGTSASLAISGLRSE DEADYYCAAWDDSLSGRVF GGGTKLTVL | 1812 | EVQLVQSGAEVKKPGSSVKV SCKASGGTFSSYAISWVRQA PGQGLEWMGGIIPIFGTANY AQKFQGRVTITADESTSTAY MELSSLRSEDTAVYYCARDG VVVPAVMYDTTDPYYYGM DVWGQGTTVTVSS |
| 37 | 1813 | ELELTQPPSVSGTPGQRVTIS CSGSSSNIGSNYVYWYQQLP GTAPKLLIYRNNQRPPGVPD RFSGSKSGTSASLAISGLRSE DEADYYCAAWDDSLSGRVF GGGTELTVL | 1814 | EVQLVQSGAEVKKPGSSVKV SCKASGGTFSSYAISWVRQA PGQGLEWMGGIIPIFGTANY AQKFQGRVTITADESTSTAY MELSSLRSEDTAVYYCARDG VVVPAVMYDTTDPYYYGM DVWGQGTTVTVSS |
| 38 | 1815 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGRVF GGGTKLTVL | 1816 | QVQLVQSGAEVKKPGSSVK VSCKASGGTFSSYAISWVRQ APGQGLEWMGGIIPIFGTAN YAQKFQGRVTITADESTSTA YMELSSLRSEDTAVYYCARD GVVVPAVMYDTTDPYYYG MDVWGQGTTVTVSS |
| 39 | 1817 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGRVF GGGTKLTVL | 1818 | EVQLVQSGAEVKKPGSSVKV SCKASGGTFSSYAISWVRQA PGQGLEWMGGIIPIFGTANY AQKFQGRVTITADESTSTAY MELSSLRSEDTAVYYCARDG VVVPAVMYDTTDPYYYGM DVWGQGTTVTVSS |

TABLE 2-continued

| No. | SEQ: ID | LC variable region | SEQ: ID | HC variable region |
|---|---|---|---|---|
| 40 | 1819 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGRVF GGGTKLTVL | 1820 | EVQLVQSGAEVKKPGSSVKV SCKASGGTFSSYAISWVRQA PGQGLEWMGGIIPIFGTANY AQKFQGRVTITADESTSTAY MELSSLRSEDTAVYYCARDG VVVPAVMYDTTDPYYYGM DVWGQGTTVTVSS |
| 41 | 1821 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGKVF GGGTKVTVL | 1822 | EVQLVQSGAEVKKPGSSVKV SCKASGGTFSSYAISWVRQA PGQGLEWMGGIIPIFGTANY AQKFQDRVTITADESTSTAY MELSSLRSEDTAVYYCARDG VVVPAVMYDTTDPYYYGM DVWGQGTTVTVSS |
| 42 | 1823 | ELELTQPPSVSGTPGQRVTIS CSGSSSNIGSNYVYWYQQLP GTAPKLLIYRNNQRPSGVPD RFSGSKSGTSASLAISGLRSE DEADYYCAAWDDSLSGKVF GGGTKVTVL | 1824 | EVQLVQSGAEVKKPGSSVKV SCKASGGTFSSYAISWVRQA PGQGLEWMGGIIPIFGTANY AQKFQDRVTITADESTSTAY MELSSLRSEDTAVYYCARDG VVVPAVMYDTTDPYYYGM DVWGQGTTVTVSS |
| 43 | 1825 | ELELTQPPSVSGTPGQRVTIS CSGSSSNIGSNYVYWYQQLP GTAPKLLIYRNNQRPPGVPD RFSGSKSGTSASLAISGLRSE DEADYYCAAWDDSLSGRVF GGGTELTVL | 1826 | EVQLVQSGAEVKKPGSSVKV SCKASGGTFSSYAISWVRQA PGQGLEWMGGIIPIFGTANY AQKFQGRVTITADESTSTAY MELSSLRSEDTAVYYCARDG VVVPAVMYDTTDPYYYGM DVWGQGTTVTVSS |
| 44 | 1827 | ELVMTQSPATLSLSPGERATL SCRASQSVSSYLAWYQQKPG QAPRLLIYDASNRATGIPDRF SGSGSGTDFTLTISRLEPEDF AVYYCQQYVTTPYTFGQGT KVDIK | 1828 | QVQLQESGPGLVKPSETLSLT CTVSGGSISRSSYYWGWIRQ PPGKGLEWIGNIYYSGSTYY NPSLKSRVTIPVDTSKNQFSL KLSSVTAADTAVYYCARGSR GYYDILTGYSTGGFDYWGQ GTLVTVSS |
| 45 | 1829 | ELVMTQSPATLSVSPGERAT LSCRASQSISSYLAWYQQKP GQAPRLLIYDASNRATGIPAR FSGSGSGTEFTLTISRLEPEDF AVYYCQQYGSSPLTFGGGTK LEIK | 1830 | QVQLQESDPGLVKPSETLSLT CTVSGDSISSSSYYWGWIRQP PGKGLEWIGNIFYSGSTYYNP SLKSRVTISVDTSKNQFSLKL SSVTAADTAVYYCARGSRG YYDILTGYSTGGFDYWGQGT LVTVSS |
| 46 | 1831 | ELTLTQSPGTLSLSPGERATL SCRASQSVSSSYLAWYQQKP GQAPRLLIYGASSRATGIPDR FSGSGSGTDFTLTISRLEPEDF AVYYCQQYGSSPLTFGGGTK VEIK | 1832 | EVQLVESGPGLVKPSETLSLT CTVSGDSISSSSYYWGWIRQP PGKGLEWIGNIFYSGSTYYNP SLKSRVTISVDTSKNQFSLKL SSVTAADTAVYYCARGSRG YYDILTGYSTGGFDYWGQGT LVTVSS |
| 47 | 1833 | ELVMTQSPGTLSLSPGERATL FCRASQSVSSSYLAWYQQKP GQAPRLLIYDASNRATGIPAR FSGSGSGTDFTLTISSLEPEDF ALYYCQQYGSSPLTFGGGTK LEIK | 1834 | QVQLQESGPGLVKPSETLSLT CTVSGDSISSSSYYWGWIRQP PGKGLEWIGNIFYSGSTYYNP SLKSRATISVDTSKNQFSLKL SSVTAADTAVYYCARGSRG YYDILTGYSTGGFDYWGQGT LVTVSS |
| 48 | 1835 | ELTLTQSPGTLSLSPGERATL SCRASQSVSSSYLAWYQQKP GQAPRLLIYGASSRATGIPDR FSGSGSGTDFTLTISRLEPEDF AVYYCQQYGSSPLTFGGGTK VEIK | 1836 | QVQLQESGPGLVRPSETLSLT CSVSGGSISHYFWSWIRQSPG KGLEWIGNIYYSGSTYYNPSL KSRVTISVDTSKNQFSLKLSS VTAADTAVYYCARGSRGYY DILTGYSTGGFDYWGQGTLV TVSS |
| 49 | 1837 | ELALTQPPSVSGSPGQSITISC TGTSSDVGGYNYVSWYQQH PGKAPKLMIYDVSNRPSGVS NRFSGSKSGNTASLTISGLQA EDEADYYCSSYTSSSTVVFG GGTKVTVL | 1838 | QVQLQESGPGLVRPSETLSLT CTVSGDSISSSSYYWGWIRQP PGKGLEWIGNIFYSGSTYYNP SLKSRVTISVDTSKNQFSLKL SSVTAADTAVYYCARGSRG YYDILTGYSTGGFDYWGQGT LVTVSS |
| 50 | 1839 | ELVMTQSPATLSVSPGERAT LSCRASQSISSYLAWYQQKP GQAPRLLIYDASNRATGIPAR FSGSGSGTEFTLTISRLEPEDF AVYYCQQYGSSPLTFGGGTK LEIK | 1840 | QVQLQESDPGLVKPSETLSLT CTVSGDSISSSSYYWGWIRQP PGKGLEWIGNIFYSGSTYYNP SLKSRVTISVDTSKNQFSLKL SSVTAADTAVYYCARGSRG YYDILTGYSTGGFDYWGQGT LVTVSS |

TABLE 2-continued

| No. | SEQ: ID | LC variable region | SEQ: ID | HC variable region |
|---|---|---|---|---|
| 51 | 1841 | ELVMTQSPATLSVSPGERATLSCRASQSISSYLAWYQQKPGQAPRLLIYDASNRATGIPARFSGSGSGTEFTLTISRLEPEDFAVYYCQQYGSSPLTFGGGTKLEIK | 1842 | QVQLQESDPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |
| 52 | 1843 | ELVMTQSPGTLSLSPGERATLFCRASQSVSSSYLAWYQQKPGQAPRLLIYDASNRATGIPARFSGSGSGTDFTLTISSLEPEDFALYYCQQYGSSPLTFGGGTKLEIK | 1844 | QVQLQESGPGLVKPSETLSLTCTVSGDSISSSSYYWGWIRQPPGKGLEWIGNIFYSGSTYYNPSLKSRATISVDTSKNQFSLKLSSVTAADTAVYYCARGSRGYYDILTGYSTGGFDYWGQGTLVTVSS |
| 53 | 1845 | ELQMTQSPGTLSLSPGERATLSCRASQSISSYLAWYQQKPGQSPRLLIYGGSSRATGIPDRFSGSGSGTDFTLTISRLEPADFAVYYCQQYGSSPLTFGQGTRLEIK | 1846 | QVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |
| 54 | 1847 | ELELTQPPSVSGSPGQSITISCTGTSSDVGGYNYVSWYQQHPGKAPKLMIYDVSNRPSGASNRFSGSKSGNTASLTISGLQAEDEADYYCSSYTSSSTHVFGTGTKVTVL | 1848 | RVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |
| 55 | 1849 | ELVLTQSPATLSLSPGERATLSCRASQSVSTYLAWYQQKPGQAPRLLIYDASNRATGIPDRFSGSGSGTDFTLTISRLEPEDFAVYYCQQYGSSPSITFGQGTRLEIK | 1850 | QVQLQESGPGLVKPSETLSLTCTVSGGSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |
| 56 | 1851 | ELTLTQSPGTLSLSPGERATLSCRASQSVSSSYLAWYQQKPGQAPRLLIYGASSRATGIPDRFSGSGSGTDFTLTISRLEPEDFAVYYCQEYGSSPGRVTFGPGTKVDIK | 1852 | QVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |
| 57 | 1853 | ELVMTQSPGILSLSPGERATLSCRASQSVSSSYLAWYQQKPGQAPRLLIYGASSRATGIPDRFSGSGSGTDFTLTISRLEPEDFAVYYCQQYGSSPLTFGGGTKVDIK | 1854 | QVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |
| 58 | 1855 | ELTLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK | 1856 | EVOLVESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |
| 59 | 1857 | ELTLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK | 1858 | EVOLVESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |
| 60 | 1859 | ELTLTQSPGTLSLPPGERATLSCRASQSVSSSYLAWYQQKPGQAPRLLIYGASSRATGIPDRFSGSGSGTDFTLTISRLEPEDFAVYYCQQYGSSPLTFGGGTKVEIK | 1860 | QVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |
| 61 | 1861 | ELVLTQSPGTLSLSPGERATLSCRASQSVSSYLAWYQQKPGQAPRLLIYDASNRATGIPARFSGSGSGTDFTLTISSLQAEDVAVYYCQQYYSTPSITFGQGTRLEIK | 1862 | QVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |

TABLE 2-continued

| No. | SEQ: ID | LC variable region | SEQ: ID | HC variable region |
|---|---|---|---|---|
| 62 | 1863 | ELVMTQSPGTLSLSPGERATLFCRASQSVSSSYLAWYQQKPGQAPRLLIYDASNRATGIPARFSGSGSGTDFTLTISSLEPEDFALYYCQQYGSSPLTFGGGTKLEIK | 1864 | QVQLQESGPGLVKPSETLSLTCTVSGDSISSSSYYWGWIRQPPGKGLEWIGNIFYSGSTYYNPSLKSRATISVDTSKNQFSLKLSSVTAADTAVYYCARGSRGYYDILTGYSTGGFDYWGQGTLVTVSS |
| 63 | 1865 | ELELTQPPSVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL | 1866 | QVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCVRGSRGYYDILTGYSTGGFDYWGQGTLVTVSS |
| 64 | 1867 | ELVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK | 1868 | QVQLQESGPGLVKPSETLSLTCTVSGDSISSSSYYWGWIRQPPGKGLEWIGNIFYSGSTYYNPSLKSRATISVDTSKNQFSLKLSSVTAADTAVYYCARGSRGYYDILTGYSTGGFDYWGQGTLVTVSS |
| 65 | 1869 | ELVMTQSPATLSLSPGESATLACRASQSVSSSFLAWYQQRPGQAPRLLIYGASSRATGIPDRFSGSGSGTDFTLTISRLEPEDFAVYYCQEYGSSPGRVTFGPGTKVDIK | 1870 | QVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |
| 66 | 1871 | ELVMTQSPGTLSLSPGERATLSCRASQSVSNYLAWYQQKPGQAPRLLIYDASNRATGIPARFSGSGSGTDFTLTISSLEPEDFAVYYCQQYGSSPLTFGGGTRLEIK | 1872 | QVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |
| 67 | 1873 | ELVMTQSPGTLSLSPGERATLSCRASQSVSNYLAWYQQKPGQAPRLLIYDASNRATGIPARFSGSGSGTDFTLTISSLEPEDFAVYYCQQYGSSPLTFGGGTRLEIK | 1874 | QVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |
| 68 | 1875 | ELTLTQSPGTLSLSPGERATLPCRASQSVSSSYLAWYQQKPGQAPRLLIYGASSRATGIPDRFSGSGSGTDFTLTISRLEPEDFAVYYCQEYGSSPGRVTFGPGTKLEIK | 1876 | QVQLQESGPGLVKPSETLSLTCTVSGDSISSSSYYWGWIRQPPGKGLEWVGNIFYSGSTYYNPSLKSRVTISVDTSKNQFSLKLSSVTAADTAVYYCARGSRGYYDILTGYSTGGFDYWGQGTLVTVSS |
| 69 | 1877 | ELTLTQSPATLSVSPGERATLSCRASQSVRSSYLAWYQQKPGQAPRLLIHAASTRATGIPDRFSGSGSGTDFTLTISRVEPEDVAVYYCQQYGDSLSITFGQGTRLEIK | 1878 | QVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |
| 70 | 1879 | ELTLTQSPATLSVSPGERATLSCRASQSVSSYLAWYQQKPGQAPRLLIYDASNRATGIPARFSGSGSGTDFTLTISRLEPEDFAVYYCQQYGSSPSITFGQGTRLEIK | 1880 | QVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |
| 71 | 1881 | ELVLTQSPATLSVSPGEGATLSCRASQSVSSNLAWYQHKPGQAPRLLIYDASTRATGIPARFSGSGSGTEFTLTISSLQSEDFAVYYCQQYNNWPLTFGGGTKVDIK | 1882 | QVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |
| 72 | 1883 | ELELTQPPSVSGTPGQRVTISCSGSSSNIGSNYVSWYQQHPGKAPKLMIYDVSNRPSGVSNRFSGSKSGNTASLTISGLQAEDEADYYCSSYTSSSTLPFGTGTKVTVL | 1884 | QVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS |

TABLE 2-continued

| No. | SEQ: ID | LC variable region | SEQ: ID | HC variable region |
|---|---|---|---|---|
| 73 | 1885 | ELVMTQSPATLSLSPGESATL ACRASASQSVSSSFLAWYQQRP GQAPRLLIYGASSRATGIPDR FSGSGSGTDFTLTISRLEPEDF AVYYCQEYGSSPGRVTFGPG TKVDIK | 1886 | QVQLQESGPGPVKPSETLSLT CTVSGDSISSSSYVWIRQP PGKGLEWIGNIFYSGSTYYNP SLKSRVTISVDTSKNQFSLKL SSVTAADTAVYYCARGSRG YYDILTGYSTGGFDYWGQGT LVTVSS |
| 74 | 1887 | ELVMTQSPGTLSLSPGERATL SCRASQSVSNYLAWYQQKP GQAPRLLIYDASNRATGIPAR FSGSGSGTDFTLTISSLEPEDF AVYYCQQYGSSPLTFGGGTR LEIK | 1888 | QVQLQESGPGLVKPSETLSLT CTVSGDSISSSSYYWGWIRQP PGKGLEWIGNIFYSGSTYYNP SLKSRVTISVDTSKNQFSLKL SSVTAADTAVYYCARGSRG YYDILTGYSTGGFDYWGQGT LVTVSS |
| 75 | 1889 | ELTLTQSPGTLSLSPGERATL SCRASQSVSSSYLAWYQQKP GQAPRLLIYGASSRATGIPDR FSGSGSGTDFTLTISRLEPEDF AVYYCQQYGSSPLTFGGGTK VEIK | 1890 | EVQLVESGPGLVKPSETLSLT CTVSGDSISSSSYYWGWIRQP PGKGLEWIGNIFYSGSTYYNP SLKSRVTISVDTSKNQFSLKL SSVTAADTAVYYCARGSRG YYDILTGYSTGGFDYWGQGT LVTVSS |
| 76 | 1891 | ELVMTQSPGTLSLSPGERATF FCRASQSVSSSYLAWYQQKP GQAPRLLIYDASNRATGIPAR FSGSGSGTDFTLTISSLEPEDF ALYYCQQYGSSPLTFGGGTK LEIK | 1892 | QVQLQESGPGLVKPSETLSLT CTVSGDSISSSSYYWGWIRQP PGKGLEWIGNIFYSGSTYYNP SLKSRATISVDTSKNQFSLKL SSVTAADTAVYYCARGSRG YYDILTGYSTGGFDYWGQGT LVTVSS |
| 77 | 1893 | ELVLTQSPATLSVSPGEGATL SCRASQSVSSNLAWYQHKPG QAPRLLIYDASTRATGIPARF SGSGSGTEFTLTISSLQSEDFA VYYCQQYNNWPLTFGGGTK VDIK | 1894 | QVQLQESGPGLVKPSETLSLT CTVSGDSISSSSYYWGWIRQP PGKGLEWIGNIFYSGSTYYNP SLKSRVTISVDTSKNQFSLKL SSVTAADTAVYYCARGSRG YYDILTGYSTGGFDYWGQGT LVTVSS |
| 78 | 1895 | ELVMTQSPGTLSLSPGERATL FCRASQSVSSSYLAWYQQKP GQAPRLLIYDASNRATGIPAR FSGSGSGTDFTLTISSLEPEDF ALYYCQQYGSSPLTFGGGTK LEIK | 1896 | QVQLQESGPGLVKPSETLSLT CTVSGDSISSSSYYWGWIRQP PGKGLEWIGNIFYSGSTYYNP SLKSRATISVDTSKNQFSLKL SSVTAADTAVYYCARGSRG YYDILTGYSTGGFDYWGQGT LVTVSS |
| 79 | 1897 | ELVLTQSPGTLSLSPGERATL SCRASQSVSSYLAWYQQKPG QAPRLLIYDASNRATGIPARF SGSGSGTDFTLTISSLQAEDV AVYYCQQYYSTPSITFGQGT RLEIK | 1898 | QVQLQESGPGLVKPSETLSLT CTVSGDSISSSSYYWGWIRQP PGKGLEWIGNIFYSGSTYYNP SLKSRVTISVDTSKNQFSLKL SSVTAADTAVYYCARGSRG YYDILTGYSTGGFDYWGQGT LVTVSS |
| 80 | 1899 | ELVMTQSPGTLSLSPGERATL SCRASQSVSNYLAWYQQKP GQAPRLLIYDASNRATGIPAR FSGSGSGTDFTLTISSLEPEDF AVYYCQQYGSSPLTFGGGTR LEIK | 1900 | QVQLQESGPGLVKPSETLSLT CTVSGDSISSSSYYWGWIRQP PGKGLEWIGNIFYSGSTYYNP SLKSRVTISVDTSKNQFSLKL SSVTAADTAVYYCARGSRG YYDILTGYSTGGFDYWGQGT LVTVSS |
| 81 | 1901 | ELTLTQSPATLSLSPGERATL SCRASQSVSSYLAWYQQKPG QAPRLLIYDASNRATGIPARF SGSGSGTDFTLTISSLEPEDFA VYYCQQYGSSPLTFGGGTKV EIK | 1902 | QVQLQESGPGLVKPSETLSLT CTVSGDSISSSSYYWGWIRQP PGKGLEWIGNIFYSGSTYYNP SLKSRVTISVDTSKNQFSLKL SSVTAADTAVYYCARGSRG YYDILTGYSTGGFDYWGQGT LVTVSS |
| 82 | 1903 | ELTLTQSPATLSLSPGERATL SCRASQSVSSYLAWYQQKPG QAPRLLIYDASNRATGIPARF SGSGSGTDFTLTISSLEPEDFA VYYCQQYGSSPLTFGGGTKV EIK | 1904 | QVQLQESGPGLVKPSETLSLT CTVSGDSISSSSYYWGWIRQP PGKGLEWIGNIFYSGSTYYNP SLKSRVTISVDTSKNQFSLKL SSVTAADTAVYYCARGSRG YYDILTGYSTGGFDYWGQGT LVTVSS |
| 83 | 1905 | ELQMTQSPATLSVSPGERAT LSCRASQSVSSNLAWYQQKP GQAPRLLIYGASTRATGIPAR FSGSGSGTEFTLTISSLQSEDF AVYYCQQYNNWPLTFGGGT KLEIK | 1906 | QVQLQESGPGLVKPSETLSLT CTVSGDSISGSSYYWGWIRQ PPGKGLEWIGNIFYSGSTYYN PSLKSRVTISVDTSKNQFSLK LSSVTAADTAMYYCARGSR GYYDILTGYSTGGFDYWGQ GTLVTVSS |

TABLE 2-continued

| No. | SEQ: ID | LC variable region | SEQ: ID | HC variable region |
|---|---|---|---|---|
| 84 | 1907 | ELELTQPPSVSGSPGQSITISC TGTSSDVGGYNYVSWYQQH PGKAPKLMIYDVSNRPSGVS NRFSGSKSGNTASLTISGLQA EDEADYYCSSYTSSSTWVFG GGTKLTVL | 1908 | QVQLQESGPGLVKPSETLSLT CTVSGDSISSSSYYWGWIRQP PGKGLEWIGNIFYSGSTYYNP SLKSRVTISVDTSKNQFSLKL SSVTAADTAVYYCVRGSRG YYDILTGYSTGGFDYWGQGT LVTVSS |
| 85 | 1909 | ELVMTQSPATLSVSPGERAT LSCRASQSISSYLAWYQQKP GQAPRLLIYDASNRATGIPAR FSGSGSGTEFTLTISRLEPEDF AVYYCQQYGSSPLTFGGGTK LEIK | 1910 | QVQLQESDPGLVKPSETLSLT CTVSGDSISSSSYYWGWIRQP PGKGLEWIGNIFYSGSTYYNP SLKSRVTISVDTSKNQFSLKL SSVTAADTAVYYCARGSRG YYDILTGYSTGGFDYWGQGT LVTVSS |
| 86 | 1911 | ELVLTQSPATLSLSPGERATL SCRASQSVSSYLAWYQQRA GQAPRLLIYDASSRATGIPDR FSGSGSGTDFTLTISRLEPEDF AVYYCQQYGSSPYTFGQGT KLEIK | 1912 | EVQLVQSGPGLVKPSETLSLT CTVSGDSISSSSYYWGWIRQP PGKGLEWIGNIFYSGSTYYNP SLKSRVTISVDTSKNQFSLKL SSVTAADTAVYYCARGSRG YYDILTGYSTGGFDYWGQGT LVTVSS |
| 87 | 1913 | ELVMTQSPGTLSLSPGERATL SCRASQSVSNYLAWYQQKP GQAPRLLIYDASNRATGIPAR FSGSGSGTDFTLTISSLEPEDF AVYYCQQYGSSPLTFGGGTR LEIK | 1914 | QVQLQESGPGLVKPSETLSLT CTVSGDSISSSSYYWGWIRQP PGKGLEWIGNIFYSGSTYYNP SLKSRVTISVDTSKNQFSLKL SSVTAADTAVYYCARGSRG YYDILTGYSTGGFDYWGQGT LVTVSS |
| 88 | 1915 | ELVMTQSPGTLSLSPGERATL SCRASQSVSSYLAWYQQKPG QAPRLLIYDASNRATGIPDRF SGSGSGTDFTLTISRLEPEDF AVYYCQQYGSSPSITFGQGT RLEIK | 1916 | QVQLQESGPGLVKPSETLSLT CTVSGDSISSSSYYWGWIRQP PGKGLEWIGSIYYSGSTYYNP SLKSRVTISVDTSKNQFSLNL SSATAADTAVYYCARGSRG YYDFLTGYSTGGFDYWGQG TLVAVSS |
| 89 | 1917 | ELVLTQPPSVSAAPRQKVTIS CSGSSSNIGDNYVSWYQQFP GTAPKLLIYDNDKRPSGIPDR FSGSKSGTSATLGITGLQTGD EADYYCGTWDSSLSAVVFG GGTQLTVL | 1918 | QITLKESGPTLVKPSQTLTLT CTFSGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 90 | 1919 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTELTVL | 1920 | QITLKESGPTLVKPSQTLTLT CTFSGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 91 | 1921 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDNSLSAGVFG TGTKVTVL | 1922 | QITLKESGPTLVKPAQTLRLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVFS |
| 92 | 1923 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 1924 | EVQLLESGPGLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 93 | 1925 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGRFG GGTKLTVL | 1926 | QITLKESGPTLVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGVDVWGQ GTTVTVSS |
| 94 | 1927 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTELTVL | 1928 | QITLKESGPTLVKPSQTLTLT CTFSGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |

TABLE 2-continued

| No. | SEQ: ID | LC variable region | SEQ: ID | HC variable region |
|---|---|---|---|---|
| 95 | 1929 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTELTVL | 1930 | QITLKESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 96 | 1931 | ELELTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTELTVL | 1932 | QITLKESGPTLVKPSQTLTLTCTFSGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 97 | 1933 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTELTVL | 1934 | QITLKESGPTLVKPSQTLTLTCTFSGFSLTTSGMGVSWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 98 | 1935 | ELVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL | 1936 | QITLKESGPTLVKPSQTLTLTCSFSGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 99 | 1937 | ELELTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKVTVL | 1938 | QITLKESGPTLVKPSQTLTLTCTFSGFSLTTSGMGVGWIRQPPGKALEWLGLIDWDDNKYYTTSLKTRLTISKDTSKNQVVLTMTNMDPVDTATYYCARIPGFLRYRNRYYYYGMDVWGQGTTVTVSS |
| 100 | 1939 | ELVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL | 1940 | QITLKESGPTLVKPSQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 101 | 1941 | ELVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL | 1942 | QITLKESGPTLVKPSQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 102 | 1943 | ELVLTQPPSVSAAPGRKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL | 1944 | QITLKESGPTLVKPTQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 103 | 1945 | ELVLTQPPSVSAAPGQKVTISCSGSSSNIGKNYVSWYQQLPGTAPKLLIYDNNKRPSGIPDRFSGSKSGTSATLGITGLQTGDEADYYCGTWDSSLSAVVFGGGTKVTVL | 1946 | QITLKESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 104 | 1947 | ELVVTQPPSVSAAPGQKVTISCSGGSSNIGNNYVSWYQQLPGTAPKLLIYDNNKRPSGIPDRFSGSKSGTSATLGITGLQTGDEADYYCGTWDSSLSAGVFGGGTKVTVL | 1948 | QVQLQESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 105 | 1949 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTQLTVL | 1950 | QITLKESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |

TABLE 2-continued

| No. | SEQ: ID | LC variable region | SEQ: ID | HC variable region |
|---|---|---|---|---|
| 106 | 1951 | ELVLTQPPSVSAAPGRKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 1952 | QITLKESGPTLVKPTQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 107 | 1953 | ELVLTQPPSVSAAPGRKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 1954 | QITLKESGPTLVKPTQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 108 | 1955 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 1956 | QITLKESGPTLVKPTQTLTLT CTFSGFSLSTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 109 | 1957 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 1958 | QITLKESGPTLVKPTQTLTLT CTFSGFSLSTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 110 | 1959 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTELTVL | 1960 | QITLKESGPTLVKPSQTLTLT CTFSGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 111 | 1961 | ELVVTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 1962 | QITLKESGPTLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 112 | 1963 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKVTVL | 1964 | QITLKESGPTLVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVSS |
| 113 | 1965 | ELVLTQPPSVSAAPGQKVTIS CSGSNSNIGNNYISWYQQFP GTAPKLLIYDNNKRPSGIPDR FSGSKSGTSATLGITGLQTGD EADYYCGTWDSSLSAGVFG GGTKVTVL | 1966 | QITLKESGPALVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVSS |
| 114 | 1967 | ELVLTQPPSVSAAPGRKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 1968 | QITLKESGPTLVKPTQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 115 | 1969 | ELVVTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 1970 | QITLKESGPTLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 116 | 1971 | ELVLTQPPSVSAAPGRKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 1972 | QITLKESGPTLVKPTQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |

TABLE 2-continued

| No. | SEQ: ID | LC variable region | SEQ: ID | HC variable region |
|---|---|---|---|---|
| 117 | 1973 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 1974 | QITLKESGPTLVKPTQTLTLT CTFSGFSLSTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 118 | 1975 | ELVVTQPPSVSAAPGQKVTIS CSGSNSNIGNNYVSWYQQLP GTAPKLLIYDNNKRPSGIPDR FSGSKSGTSATLGITGLQTGD EADYYCGTWDNSLSAGVFG TGTKVTVL | 1976 | QITLKESGPTLVKPSQTLTLT CTFSGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 119 | 1977 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 1978 | QITLKESGPTLVKPTQTLTLT CTFSGFSLSTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 120 | 1979 | ELVVTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAVVFG GGTELTVL | 1980 | QITLKESGPTLVKPTQTLTLT CTFSGFSLSTSGVGVGWIRQP PGKALEWLTLIDWDDNKYY TTSLKTRLTISKDTSKNQVVL TMTNMDPVDTATYYCARIP GFLRYRNRYYYYGMDVWG QGTTVTVSS |
| 121 | 1981 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTQLTVL | 1982 | QITLKESGPTLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 122 | 1983 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 1984 | QITLKESGPTLVKPTQTLTLT CTFSGFSLSTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 123 | 1985 | ELVVTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 1986 | QITLKESGPTLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 124 | 1987 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDNSLSAGVFG TGTKVTVL | 1988 | QITLKESGPTLVKPAQTLRLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVFS |
| 125 | 1989 | ELVVTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 1990 | QITLKESGPTLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 126 | 1991 | ELVLTQPPSVSAAPGRKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 1992 | QITLKESGPTLVKPTQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 127 | 1993 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDNSLSAGVFG TGTKVTVL | 1994 | QITLKESGPTLVKPAQTLRLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVFS |

TABLE 2-continued

| No. | SEQ: ID | LC variable region | SEQ: ID | HC variable region |
|---|---|---|---|---|
| 128 | 1995 | ELVLTQPPSVSAAPGQKVTIS CSGSTSNIGNNFVSWYQHLP GTAPKLLIYDNDKRPSGIPDR FSGSKSGTSATLGITGLQTGD EADYYCGTWDSSLSAGVFG GGTKLTVL | 1996 | QITLKESGPTLVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVSS |
| 129 | 1997 | ELELTQPPSVSAAPGQKVTIS CSGSNSNIGNNYVSWYQQLP GTAPKLLIYDNNKRPSGIPDR FSSSKSGTSATLGITGLQTGD EADYYCGTWDNNLSAGVFG TGTKVTVL | 1998 | QITLKESGPTLVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVSS |
| 130 | 1999 | ELVLTQPPSVSAAPGRKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 2000 | QITLKESGPTLVKPTQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 131 | 2001 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKVTVL | 2002 | QITLKESGPTLVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVSS |
| 132 | 2003 | ELVVTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 2004 | QITLKESGPTLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 133 | 2005 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTQLTVL | 2006 | QITLKESGPSLVKPSQTLTLT CTFSGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 134 | 2007 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 2008 | QITLKESGPTLVKPTQTLTLT CTFSGFSLSTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 135 | 2009 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKVTVL | 2010 | QITLKESGPTLVKPSQTLTLT CTFSGFSLTTSGMGVGWIRQ PPGKALEWLGLIDWDDNKY YTTSLKTRLTISKDTSKNQVV LTMTNMDPVDTATYYCARIP GFLRYRNRYYYYGMDVWG QGTTVTVSS |
| 136 | 2011 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTQLTVL | 2012 | QITLKESGPTLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 137 | 2013 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTELTVL | 2014 | QITLKESGPTLVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVSS |
| 138 | 2015 | ELVVTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTELTVL | 2016 | QITLKESGPTLVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVSS |

TABLE 2-continued

| No. | SEQ: ID | LC variable region | SEQ: ID | HC variable region |
|---|---|---|---|---|
| 139 | 2017 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTELTVL | 2018 | QITLKESGPTLVKPTQTLTLTCSFSGFSLSTSGVGVGWIRQPPGKALEWLALIDWDDNKYHTTSLKTRLTISKDTSKNQVVLTMTNMDPVDTATYYCARIPGFLRYRNRYYYYGMDVWGQGTTVTVSS |
| 140 | 2019 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTELTVL | 2020 | QITLKESGPTLVKPSQTLTLTCTFSGFSLTTSGMGVSWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 141 | 2021 | ELELTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKVTVL | 2022 | QITLKESGPTLVKPSQTLTLTCTFSGFSLTTSGMGVGWIRQPPGKALEWLGLIDWDDNKYYTTSLKTRLTISKDTSKNQVVLTMTNMDPVDTATYYCARIPGFLRYRNRYYYYGMDVWGQGTTVTVSS |
| 142 | 2023 | ELVLTQPPSVSAAPGRKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL | 2024 | QITLKESGPTLVKPTQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 143 | 2025 | ELVLTQPPSASGTPGQRVTISCSGSSSNIGNNYVSWYQQLPGTAPKLLIYDNNKRPSGIPDRFSGSKSGTSATLGITGLQTGDEADYYCGTWDSSLSAGVFGGGTKVTVL | 2026 | QITLKESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 144 | 2027 | ELVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL | 2028 | QITLKESGPTLVKPSQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 145 | 2029 | ELVLTQPPSVSAAPGQKVTISCSGSSSNIGKNYVSWYQQLPGTAPKLLIYDNNKRPSGIPDRFSGSKSGTSATLGITGLQTGDEADYYCGTWDSSLSAVVFGGGTKVTVL | 2030 | QITLKESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 146 | 2031 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL | 2032 | EVQLLESGPGLVKPSQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 147 | 2033 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSGGVFGGGTKVTVL | 2034 | QITLKESGPTLVKPSQTLTLTCTFSGFSFTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 148 | 2035 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTQLTVL | 2036 | QITLKESGPTLVKPSQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 149 | 2037 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTQLTVL | 2038 | QITLKESGPSLVKPSQTLTLTCTFSGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |

TABLE 2-continued

| No. | SEQ: ID | LC variable region | SEQ: ID | HC variable region |
|---|---|---|---|---|
| 150 | 2039 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL | 2040 | EVQLLESGPGLVKPSQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 151 | 2041 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTELTVL | 2042 | QITLKESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 152 | 2043 | ELVLTQPPSVSAAPGQKVTISCSGRSSNIGNNYVSWYQQLPGTAPKLLIYDNNKRPSGIPDRFSGSKSGTSATLGITGLQTGDEADYYCGTWDSSLSAGVFGGGTQLTVL | 2044 | QITLKESGPSLVKPSQTLTLTCTFSGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 153 | 2045 | ELELTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTELTVL | 2046 | QITLKESGPALVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 154 | 2047 | ELVLTQPPSVSAAPGQKVTISCSGSSSNIGKNYVSWYQQLPGTAPKLLIYDNNKRPSGIPDRFSGSKSGTSATLGITGLQTGDEADYYCGTWDSSLSAVVFGGGTKVTVL | 2048 | QITLKESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 155 | 2049 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL | 2050 | EVQLLESGPGLVKPSQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 156 | 2051 | ELVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL | 2052 | QITLKESGPTLVKPSQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 157 | 2053 | ELELTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKVTVL | 2054 | QITLKESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 158 | 2055 | ELELTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKVTVL | 2056 | QITLKESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 159 | 2057 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTELTVL | 2058 | QITLKESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 160 | 2059 | ELELTQPPSVSGSPGQSVTISCSGSSSNIGNNYVSWYQQLPGTAPKLLIYDNNKRPSGIPDRFSGSKSGTSATLGITGLQTGDEADYYCGTWDSSLSAGVFGGGTQLTVL | 2060 | QITLKESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |

TABLE 2-continued

| No. | SEQ: ID | LC variable region | SEQ: ID | HC variable region |
|---|---|---|---|---|
| 161 | 2061 | ELVVTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 2062 | QITLKESGPTLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 162 | 2063 | ELVLTQPPSVSAAPGQKVTIS CSGSSSNIGKNYVSWYQQLP GTAPKLLIYDNNKRPSGIPDR FSGSKSGTSATLGITGLQTGD EADYYCGTWDSSLSAVVFG GGTKVTVL | 2064 | QITLKESGPTLVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVSS |
| 163 | 2065 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKVTVL | 2066 | QITLKESGPTLVKPSQTLTLT CTFSGFSLTTSGMGVGWIRQ PPGKALEWLGLIDWDDNKY YTTSLKTRLTISKDTSKNQVV LTMTNMDPVDTATYYCARIP GFLRYRNRYYYYGMDVWG QGTTVTVSS |
| 164 | 2067 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTELTVL | 2068 | QITLKESGPALVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG PRDHGHRLLSFHQG |
| 165 | 2069 | ELVVTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 2070 | QITLKESGPTLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 166 | 2071 | ELVVTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 2072 | QITLKESGPTLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 167 | 2073 | ELELTQPPSVSGSPGQSVTISC SGSSSNIGNNYVSWYQQLPG TAPKLLIYDNNKRPSGIPDRF SGSKSGTSATLGITGLQTGDE ADYYCGTWDSSLSAGVFGG GTQLTVL | 2074 | QITLKESGPTLVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVSS |
| 168 | 2075 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTQLTVL | 2076 | QITLKESGPTLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 169 | 2077 | ELVLTQPPSVSAAPGQKVTIS CSGSSSNIGKNYVSWYQQLP GTAPKLLIYDNNKRPSGIPDR FSGSKSGTSATLGITGLQTGD EADYYCGTWDSSLSAVVFG GGTKVTVL | 2078 | QITLKESGPTLVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVSS |
| 170 | 2079 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 2080 | EVQLLESGPGLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 171 | 2081 | ELVLTQPPSVSAAPGQKVTIS CSGRSSNIGNNYVSWYQQLP GTAPKLLIYDNNKRPSGIPDR FSGSKSGTSATLGITGLQTGD EADYYCGTWDSSLSAGVFG GGTQLTVL | 2082 | QITLKESGPSLVKPSQTLTLT CTFSGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |

TABLE 2-continued

| No. | SEQ: ID | LC variable region | SEQ: ID | HC variable region |
|---|---|---|---|---|
| 172 | 2083 | ELVVTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTAL | 2084 | QITLKESGPTLVKPSQTLTLT CTFSGFSLSTSGVGVGWIRQP PGKPLEWLALIDWDDNKYY TTSLKTRLTISKDTSKNQVVL TMTNMDPVDTATYYCARIP GFLRYRNRYYYYGMDVWG QGTTVTVSS |
| 173 | 2085 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTELTVL | 2086 | QITLKESGPTLVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVSS |
| 174 | 2087 | ELVVTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 2088 | QITLKESGPTLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 175 | 2089 | ELVVTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 2090 | QITLKESGPTLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 176 | 2091 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTELTVL | 2092 | QITLKESGPTLVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVSS |
| 177 | 2093 | ELVLTQPPSASGTPGQRVTIS CSGSSSNIGNNYVSWYQQLP GTAPKLLIYDNNKRPSGIPDR FSGSKSGTSATLGITGLQTGD EADYYCGTWDSSLSAGVFG GGTKVTVL | 2094 | QITLKESGPTLVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVSS |
| 178 | 2095 | ELVVTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 2096 | QITLKESGPTLVKPSQTLTLT CSFAGFSLTTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 179 | 2097 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKVTVL | 2098 | QITLKESGPTLVKPSQTLTLT CTFSGFSLTTSGMGVGWIRQ PPGKALEWLGLIDWDDNKY YTTSLKTRLTISKDTSKNQVV LTMTNMDPVDTATYYCARIP GFLRYRNRYYYYGMDVWG QGTTVTVSS |
| 180 | 2099 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKLTVL | 2100 | QITLKESGPTLVKPTQTLTLT CTFSGFSLSTSGMGVGWIRQ PPGKALEWLALIDWDDNKY YTTSLKTRLTISKDTSKNQVV LTMTNMDPVDTATYYCARIP GFLRYRNRYYYYGMDVWG QGTTVTVSS |
| 181 | 2101 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKVTVL | 2102 | QITLKESGPTLVKPSQTLTLT CTFSGFSLTTSGMGVGWIRQ PPGKALEWLGLIDWDDNKY YTTSLKTRLTISKDTSKNQVV LTMTNMDPVDTATYYCARIP GFLRYRNRYYYYGMDVWG QGTTVTVSS |
| 182 | 2103 | ELELTQPPSVSGSPGQSVTISC SGSSSNIGNNYVSWYQQLPG TAPKLLIYDNNKRPSGIPDRF SGSKSGTSATLGITGLQTGDE ADYYCGTWDSSLSAGVFGG GTQLTVL | 2104 | QITLKESGPTLVKPTQTLTLT CTFSGFSLSTSGVGVGWIRQP PGKALEWLALIDWDDNKYY TTSLKTRLTISKDTSKNQVVL TMTNMDPVDTATYYCARIP GFLRYRNRYYYYGMDVWG QGTTVTVSS |

TABLE 2-continued

| No. | SEQ: ID | LC variable region | SEQ: ID | HC variable region |
|---|---|---|---|---|
| 183 | 2105 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTQLTVL | 2106 | QITLKESGPSLVKPSQTLTLTCTFSGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 184 | 2107 | ELVLTQPPSVSAAPRQKVTISCSGSSSNIGDNYVSWYQQFPGTAPKLLIYDNDKRPSGIPDRFSGSKSGTSATLGITGLQTGDEADYYCGTWDSSLSAVVFGGGTQLTVL | 2108 | QITLKESGPTLVKPSQTLTLTCTFSGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 185 | 2109 | ELVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL | 2110 | QITLKESGPTLVKPSQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 186 | 2111 | ELVLTQPPSVSAAPGQKVTISCSGRSSNIGNNYVSWYQQLPGTAPKLLIYDNNKRPSGIPDRFSGSKSGTSATLGITGLQTGDEADYYCGTWDSSLSAGVFGGGTQLTVL | 2112 | QITLKESGPSLVKPSQTLTLTCTFSGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 187 | 2113 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKVTVL | 2114 | QITLKESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 188 | 2115 | ELELTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKVTVL | 2116 | QITLKESGPTLVKPSQTLTLTCTFSGFSLTTSGMGVGWIRQPPGKALEWLGLIDWDDNKYYTTSLKTRLTISKDTSKNQVVLTMTNMDPVDTATYYCARIPGFLRYRNRYYYYGMDVWGQGTTVTVSS |
| 189 | 2117 | ELVLTQPPSVSAAPGQKVTISCSGRSSNIGNNYVSWYQQLPGTAPKLLIYDNNKRPSGIPDRFSGSKSGTSATLGITGLQTGDEADYYCGTWDSSLSAGVFGGGTQLTVL | 2118 | QITLKESGPSLVKPSQTLTLTCTFSGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 190 | 2119 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKVTVL | 2120 | QITLKESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 191 | 2121 | ELVLTQPPSVSAAPGRKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL | 2122 | QITLKESGPTLVKPTQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 192 | 2123 | ELVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL | 2124 | QITLKESGPTLVKPSQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |
| 193 | 2125 | ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTQLTVL | 2126 | QITLKESGPSLVKPSQTLTLTCTFSGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS |

TABLE 2-continued

| No. | SEQ: ID | LC variable region | SEQ: ID | HC variable region |
|---|---|---|---|---|
| 194 | 2127 | ELELTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKVTVL | 2128 | QITLKESGPTLVKPSQTLTLTCTFSGFSLTTSGMGVGWIRQPPGKALEWLGLIDWDDNKYYTTSLKTRLTISKDTSKNQVVLTMTNMDPVDTATYYCARIPGFLRYRNRYYYYGMDVWGQGTTVTVSS |
| 195 | 2129 | ELMLTQPHSVSGSPGKTVTISCTRSSGSIASNYVQWYQQRPGSSPTTVIYEDNQRPSGVPDRFSGSIDSSSNSASLTISGLKTEDEADYYCQSYDSSDWVFGGGTKVTVL | 2130 | QVQLVQSGAEVKKPGASVKVSCKASGYNFTRYGISWVRQAPGQGLEWMGWISAYNGNTKYAQKLQGRVTMTTDTSTSTAYLELRSLRSDDTAVYYCARVLGIAVAGTPIWGQGTLVTVSS |
| 196 | 2131 | ELVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTQLTVL | 2132 | QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARVRGYSGYGSTYYFDYWGQGTLVTVSS |
| 197 | 2133 | ELVLTQPPSVSGAPGQRVTISCTGSSSNIGAGYDVHWYQQFPGTAPKLLIYGNSNRPSGVPDRFSGSKSGTSASLAITGLQAEDEADYYCQSYDSSLSGSIFGGGTKLTVL | 2134 | QVQLVQSGAEVKKPGSSVKVSCEASGGTFSSYAISWVRQAPGQGLEWMGGIIPILGIANYAQKFQGRVTITADKSTSTAYMELSSLRSEDTAVYYCARVRGYSGYGSTYYFDYWGQGTLVTVSS |
| 198 | 2135 | ELVLTQPPSVSGAPGQRVAISCTGSSSNIGAGYDVHWYQQLPGTAPKLLIYGNSNRPSGVPDRFSGSRSGTSASLAITGLQAEDEADYYCQSYDSSLSGSVFGGGTKLTVL | 2136 | QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARVRGYSGYGSTYYFDYWGQGTLVTVSS |
| 199 | 2137 | ELVLTQPPSVSGAPGQRVTISCTGSSSNIGAGYDVHWYQQFPGTAPKLLIYGNSNRPSGVPDRFSGSKSGTSASLAITGLQAEDEADYYCQSYDSSLSGSIFGGGTKLTVL | 2138 | QVQLVQSGAEVKKPGSSVKVSCEASGGTFSSYAISWVRQAPGQGLEWMGGIIPILGIANYAQKFQGRVTITADKSTSTAYMELSSLRSEDTAVYYCARVRGYSGYGSTYYFDYWGQGTLVTVSS |
| 200 | 2139 | ELVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKVTVL | 2140 | QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARVRGYSGYGSTYYFDYWGQGTLVTVSS |
| 201 | 2141 | ELELTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKLTVL | 2142 | QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARVRGYSGYGSTYYSDYWGQGTLVTVSS |
| 202 | 2143 | ELELTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKLTVL | 2144 | QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARVRGYSGYGSTYYSDYWGQGTLVTVSS |
| 203 | 2145 | ELVLTQSPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVL | 2146 | QVQLVQSGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS |
| 204 | 2147 | ELELTQPPSVSGTPGQRVTISCSGSSSNIGSKTVNWYQHLPGTAPKLLIYSNNQRPSGVPDRFSGSKSGTSASLAISGLQSEDEADYYCATWDDSLNGWVFGGGTKLTVL | 2148 | EVQLLESGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS |

TABLE 2-continued

| No. | SEQ: ID | LC variable region | SEQ: ID | HC variable region |
|---|---|---|---|---|
| 205 | 2149 | ELVVTQPPSASGTPGQRVTISCSGSSSNIGSNTVNWYQQLPGTAPKLLIYSNNQRPSGVPDRFSGSKSGTSASLAISGLQSEDEADYYCATWDDSLNGWVFGGGTKVTVL | 2150 | QVQLVQSGGGVVQPGRSLRLSCAASGFTFSSFAMHWVRQAPGKGLEWVAVISFDGSNKYYADSVKGQFTISRDNSKNALYLQMNSLRAEDTAVYYCARGDYYGSGSYYNPSPFFDYWGQGTLVTVSS |
| 206 | 2151 | ELVVTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL | 2152 | QVQLVQSGGGVVQPGRSLRLSCAASGFTFSNFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS |
| 207 | 2153 | ELVVTQPPSASGTPGQRVTISCSGSSSNIGSNTVNWYQQLPGTAPKLLIYSNNQRPSGVPDRFSGSKSGTSASLAIRGLRSEDEADYYCATWDDALSGWVFGGGTKLTVL | 2154 | QVQLVQSGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS |
| 208 | 2155 | ELELTQPPSVSGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL | 2156 | EVQLVQSGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS |
| 209 | 2157 | ELVLTQPPSASGTPGQRVTISCSGSSSNIGSKAVNWYQHLPGTAPKLLIYSNNQRPSGVPDRFSGSKSGTSASLAISGLQSEDEADYYCATWDDSLNGWVFGGGTKVTVL | 2158 | EVQLVESGGGVVQPGRSLRLSCAASGFTFSSFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS |
| 210 | 2159 | ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL | 2160 | EVQLVESGGGVVQPGRSLRLSCAASGFTFSRFAMHWVRQAPGKGLEWVAVVSYDGSNNYYADSVKGRFTISRDNSKDTLYLQMNSLRAEDTAVYYCARGDYYGSGSYYNPSPFFDYWGQGTLVTVSS |
| 211 | 2161 | ELELTQPPSVSGAPGQRVTISCSGSRSNIGGNTVNWFQQLPGAVPKLLVYGDNQRPSGVPDRFSGSKSGTSASLAISGLRSEDEADYYCAAWDDSLSGWVFGGGTKVTVL | 2162 | QVQLVQSGGGVVQPGRSLRLSCAASGFTFSTYSMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS |
| 212 | 2163 | ELELTQPPSVSGTPGQRVTISCSGSSSNIGSNTVNWYQQLPGTAPKLLIYSNNQRPSGVPDRFSGSKSGTSASLAISGLQSEDEADYYCAAWEDSLNGYVFGTGTKVTVL | 2164 | EVQLVQSGGGVVRPGRSLRLSCAASGFTFSNFAMHWVRQAPGKGLEWVAVISYDGSNKYYADSVKGRFTISRDNSKNTLYLQMNSLRPEDTAVYYCARGDYYGSGSYYNPSPFFDYWGQGTLVTVSS |
| 213 | 2165 | ELELTQPPSVSGTPGQRVTISCSGSSSNIGSNTVNWYQQLPGTAPKLLIYSNNQRPSGVPDRFSGSKSGTSASLAISGLRSEDEADYYCAAWDDSLSGWVFGGGTKLTVL | 2166 | QVQLVQSGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS |
| 214 | 2167 | ELMLTQPHSASGTPGQRVTISCSGSSSNIGSNTVNWFQQLPGTAPKLLIYSNNQRPSGVPDRFSGSKSGTSASLAISGLRSEDEADYYCATWDDTLDSWVFGGGTKLTVL | 2168 | EVQLVESGGGVVQPGRSLRLSCPASGFTFSNFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS |
| 215 | 2169 | ELVLTQSPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVL | 2170 | EVQLLESGGGVVQPGRSLRLSCAASGFTFSSFAMHWVRQAPGKGLEWVAVISFDGSNKYYADSVKGQFTISRDNSKNTLYLQMNSLRAEDTAVYYCARGDYYGSGSYYNPSPFFDYWGQGTLVTVSS |

TABLE 2-continued

| No. | SEQ: ID | LC variable region | SEQ: ID | HC variable region |
|---|---|---|---|---|
| 216 | 2171 | ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL | 2172 | EVOLVESGGGVVQPGRSLRLSCAASGFTFSSFAMHWVRQAPGKGLEWVAVISYDGSNKYYADSVKGRFTISRDNSKNTLYLQMNSLRPEDTAVYYCARGDYYGSGSYYNPSPFFDYWGQGTLVTVSS |
| 217 | 2173 | ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNVWVFGGGTKVTVL | 2174 | EVOLVESGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS |
| 218 | 2175 | ELELTQPPSVSGTPGQRVSISCSGSTSNIGSNPVNWFQQLPGTAPKLLIYSNNQRPSGVPNRFSGSKSGTSASLAISGLQSDDEADYYCAAWDDSLNGWVFGGGTKVTVL | 2176 | QVQLVQSGGGVVQPGRSLRLSCAASGFTFSSFAMHWVRQAPGKGLEWVAVISFDGSNKYYADSVKGQFTISRDNSKNTLYLQMNSLRAEDTAVYYCARGDYYGSGSYYNPSPFFDYWGQGTLVTVSS |
| 219 | 2177 | ELVLTQPPSASGTPGQRVTISCSGSSSNIGSNTVNWYQQFPGAAPKLLIYSNSQRPSGVPDRVSASKSGTSASLAISGLQSEDEGDYYCAGWDDSLNGWVFGGGTKLTVL | 2178 | EVOLVESGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS |
| 220 | 2179 | ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKVTVL | 2180 | QVQLVQSGGGVVQPGRSLRLSCPASGFTFSNFAMHWVRQAPGKGLEWVAVISYDGSNKYFADSVKGRFTISRDNSKNTLYLQMSSLRAEDTAVYYCARGDYYGSGSYYNPSPFFDYWGQGTLVTVSS |
| 221 | 2181 | ELVLTQPPSVSGTPGQRVTISCSGSSSNIGSNTVNWYQQLPGTAPKLLIYSNNQRPSGVPDRFSGSKSGTSASLAISGLRSDDEADYYCATWDDSLSGWVFGGGTQLTVL | 2182 | QVQLVQSGGGVVQPGRSLRLSCAASGFTFSRFAMHWVRQAPGKGLEWVAVVSYDGSNNYYADSVKGRSTISRDNSKNTLYLQMNSLRAEDTAVYYCARGDYYGSGSYYNPSPFFDYWGQGTLVTVSS |
| 222 | 2183 | ELVVTQPPSASGTPGQRVTISCSGSSSNIGSNTVNWYQQLPGTAPKLLIYSNNQRPSGVPDRFSGSKSGTSASLAIRGLRSEDEADYYCATWDDALSGWVFGGGTKLTVL | 2184 | QVQLVQSGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS |
| 223 | 2185 | ELELTQPPSVSGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTQLTVL | 2186 | EVQLLESGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS |
| 224 | 2187 | ELELTQPPSVSGTPGQRVTISCSGSSSNIGSNTVNWYQQLPGTAPKLLIYSNNQRPSGVPDRFSGSKSGTSASLAISGLRSEDEADYYCATWDSSLSAWVFGGGTKLTVL | 2188 | EVOLVESGGGVVQPGRSLRLSCAASGFTFSSYSMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS |
| 225 | 2189 | ELVLTQSPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKVTVL | 2190 | EVOLVESGGGVVQPGRSLRLSCAASGFTFSTYSMHWIRQAPGKGLEWVAVISYDGSNKYYADSVKGRFTISRDNSKNTLYLQMNSLRAEDTAVYYCARGDYYGSGSYYNPSPFFDYWGQGTLVTVSS |
| 226 | 2191 | ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL | 2192 | QVQLVQSGGGVVQPGRSLRLSCAASGFTFSNFAMHWVRQAPGKGLEWVAVISYDGSNKYFADSVKGRFTISRDNSKNTLYLQMSSLRAEDTAVYYCARGDYYGSGSYYNPSPFFDYWGQGTLVTVSS |

TABLE 2-continued

| No. | SEQ: ID | LC variable region | SEQ: ID | HC variable region |
|---|---|---|---|---|
| 227 | 2193 | ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKVTVL | 2194 | EVQLVQSGGGVVQPGRSLRLSCAASGFTFSNFAMHWVRQAPGKGLEWVAVISYDGSNKYYADSVKGRFTISRDNSKNTLYLQMNSLRPEDTAVYYCARGDYYGSGSYYNPSPFFDYWGQGTLVTVSS |
| 228 | 2195 | ELVLTQPPSASGTPGQRVTLSCSGSSSNVGSNTVNWYQQLPGTAPKLLIYSNDQRPSGVPDRFSGSKSGTSASLAISGLQSGDEADYYCATWDDSLNGWVFGGGTKLTVL | 2196 | EVQLVQSGGGVVQPGRSLRLSCAASGFTFSSFAMHWVRQAPGKGLEWVAVISFDGSNKYYADSVKGQFTISRDNSKNTLYLQMNSLRAEDTAVYYCARGDYYGSGSYYNPSPFFDYWGQGTLVTVSS |
| 229 | 2197 | ELVVTQPPSVSGAPGQRVTISCSGSSSNIGSNTVNWYQQLPGTAPKLLIYSNNQRPSGVPDRFSGSKSGTSASLAISGLRSEDEADYYCAAWDDSLSGWVFGGGTKLTVL | 2198 | EVQLLESGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS |
| 230 | 2199 | ELVLTQPPSASGTPGQRVTISCSGSSSNIGSNTVNWYQQLPGTAPKLLIYSSNQRPSGVPDRFSGSKSGTSASLAISGLQSEDEADYYCAAWDDSLNGWVFGGGTKLTVL | 2200 | QVQLVQSGGGVVQPGRSLRLSCAASGFTFSNFAMHWVRQAPGKGLEWVAVISYDGSNKYYADSVKGRFTISRDNFKNTLYLQMNSLRAEDTAVYYCARGDYYGSGSYYNPSPFFDYWGQGTLVTVSS |
| 231 | 2201 | ELVLTQPPSASGTPGQRVTISCSGSSSNIGSNTVNWYQQLPGTAPKLLIYSNNQRPSGVPDRFSGSKSGTSASLAISGLQSEDEADYYCATWDDSLNGWVFGGGTKLTVL | 2202 | EVQLLESGGGVVQPGRSLRLSCAASGFTFSSFAMHWVRQAPGKGLEWVAVISFDGSNKYYADSVKGQFTISRDNSKNTLYLQMNSLRAEDTAVYYCARGDYYGSGSYYNPSPFFDYWGQGTLVTVSS |
| 232 | 2203 | ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNAWVFGGGTKLTVL | 2204 | EVQLVESGGGVVQPGRSLRLSCAASGFTFSSYSMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS |
| 233 | 2205 | ELELTQPPSVSGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKLTVL | 2206 | QVQLVQSGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS |
| 234 | 2207 | ELVLTQPPSASGTPGQRVTISCSGSSSNIGSNTVNWFQQLPGTAPKLLIYSNNQRPSGVPDRFSGSKSGTSASLAISGLQSEDEADYYCAAWDDSLNGYVFGTGTKVTVL | 2208 | QVQLVQSGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS |
| 235 | 2209 | ELELTQPPSVSGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKLTVL | 2210 | QVQLVQSGGGVVQPGRSLRLSCAASGFTFSSYAMHWVRQAPGKGLEWVAVISFDGSNKYYADSVKGQFTISRDNSKNTLYLQMNSLRAEDTAVYYCARGDYYGSGSYYNPSPFFDYWGQGTLVTVSS |
| 236 | 2211 | ELVLTQPPSASGTPGQRVTISCSGSSSNIGSNTVNWYQQLPGTAPKLLIYSNNQRPSGVPDRFSGSKSGTSASLAISGLQPEDEADYYCGTWDSNSETWVFGGGTKLTVL | 2212 | EVQLLESRGGVVQPGRSLRLSCAASGFTFSTYSMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS |
| 237 | 2213 | ELVVTQPPSVSAAPGQKVTISCSGSNSNIGSNTVNWYQQLPGTAPKLLIYSNNQRPSGVPDRFSGSKSGTSASLAISGLQSEDEADYYCAAWDDSLNGYVFGTGTKVTVL | 2214 | EVQLLESGGGVVQPGRSLRLSCAASGFTFGSFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS |

TABLE 2-continued

| No. | SEQ: ID | LC variable region | SEQ: ID | HC variable region |
|---|---|---|---|---|
| 238 | 2215 | ELVLTQSPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKVTVL | 2216 | EVOLVESGGGVVQPGRSLRLSCAASGFTFSTYSMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS |
| 239 | 2217 | DLVLTQPPSASGTPGQRVTMSCSGSSSNIGSKTVNWYQQLPGTAPKLLIYSNNQRPSGVPDRFSGSKSGTSASLAISGLRSEDEADYYCAAWDDSLSGWVFGGGTQLTVL | 2218 | EVOLVESGGGLVQPGGSLRLSCAASGFTFSNFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS |
| 240 | 2219 | ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLSGWVFGGGTKLTVL | 2220 | EVQLLESGGGVVQPGRSLRLPCAASGFTFSNFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS |
| 241 | 2221 | ELVLTQPPSASGTPGQRVTISCSGSSSNIGINSVNWYQQLPGTAPKLLIYSNNQRPSGVLDRFSGSKSGTSASLAISGLQSEDEADYYCAAWDDSLNGYVFGTGTKLTVL | 2222 | QVQLVQSGGGVVQPGRSLRLSCAASGFTFSSFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS |
| 242 | 2223 | ELVLTQPPSASGTPGQRVTISCSGSSSNIGSKTVNWYQHLPGTAPKLLIYSNNQRPSGVPDRFSGSKSGTSASLAISGLQSEDEADYYCATWDDSLNGWVFGGGTKVTVL | 2224 | EVQLLESGGGVVQPGRSLRLSCAASGFTFSSFAMHWVRQAPGKGLEWVAVISYDGSNKYYAESVKGRFTVSRDNSKNTLYLQMNSLRAEDTAVYYCARGDYYGSGSYYNPSPFFDYWGQGTLVTVSS |
| 243 | 2225 | ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLSGWVFGGGTKVTVL | 2226 | EVQLLESGGGVVQPGRSLRLSCAASGFTFSSFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS |
| 244 | 2227 | ELELTQPPSVSGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKLTVL | 2228 | EVQLLESGGGVVQPGRSLRLSCAASGFTFSNFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS |
| 245 | 2229 | ELVLTQPPSVSGTPGQRVTISCSGSSSNIGSNTVNWYQQLPGTAPKLLIYSNNQRPSGVPDRFSGSKSGTSASLAISGLQSEDEADYYCATWDDSLNAWVFGGGTKLTVL | 2230 | EVQLVQSGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS |
| 246 | 2231 | ELVVTQPPSASGTPGQRVTISCSGSSSNIGSNTVNWYQQLPGTAPKLLIYSNNQRPSGVPDRFSGSKSGTSASLAISGLQSEDEADYYCATWDDSLNGYVFGPGTKLTVL | 2232 | QVQLVQSGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS |
| 247 | 2233 | ELVLTQSPSASGTPGQRVTISCSGSSSNIGSNTVNWYQQLPGTAPKLLIYSNQRPSGVPDRFSGSKSGTSASLAISGLQSEDEADYYCAAWDDSLSGWVFGGGTELTVL | 2234 | EVOLVESGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS |
| 248 | 2235 | ELVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTELTVL | 2236 | QITLKESGPTLVKPTQTLTLTCTFSGFSLSTSGVGVGWIRQPPGKALEWLTLIDWDDNKYYTTSLKTRLTISKDTSKNQVVLTMTNMDPVDTATYYCARIPGFLRYRNRYYYYGMDVWGQGTTVTVSS |

TABLE 2-continued

| No. | SEQ: ID | LC variable region | SEQ: ID | HC variable region |
|---|---|---|---|---|
| 249 | 2237 | ELELTQPPSVSVAPGKTARIT CGGNNIGSKSVHWYQQKPG QAPVLVIYYDSDRPSGIPERF SGSNSGNTATLTISRVEAGDE ADYYCQVWDGSSDHYVFGT GTKVTVL | 2238 | VQLLESGGGLVQPGGSLRLS CAASGFTFSSYAMSWVRQAP GKGLEWVSAISGSGGSTYYA DSVKGRFTISRDNSKNTLYL QMNSLRAEDTAVYYCAKLS HGVVGAQDAFDIWGQGTMV TVSS |
| 250 | 2239 | ELELTQPPSVSGAPGQRVTIS CTGSSSNIGAGYDVHWYQQL PGTAPKLLIYGNSNRPSGVPD RFSGSKSGTSASLAITGLQAE DEADYYCQSYDSSLSGSVFG GGTQLTVL | 2240 | QVQLVQSGAEVKKPGSSVK VSCKASGGTFSSYAISWVRQ APGQGLEWMGRIIPILGIANY AQKFQGRVTITADKSTSTAY MELSSLRSEDTAVYYCAREE ATTGINTNWFDPWGQGTLVT VSS |
| 251 | 2241 | ELVLTQPPSASGTPGQRVTIS CSGSSSNIGSNTVNWYQQLP GTAPKLLIYSNNQRPSGVPD RFSGSKSGTSASLAISGLQSE DEADYYCAAWDDSLNGVVF GGGTKLTVL | 2242 | EVQLLESGGGLVQPGRTLRL SCAASGFTFDDYAMHWVRQ PPGKGLEWVSGIDWNSGLIG YADAVKGRFTLSRDNAKNSI FLQMNSLRAEDTALYYCVK DMGSTGGYYGMDVWGQGT TVTVSS |
| 252 | 2243 | ELELTQPPSVSGTPGQRVTIS CSGSSSNIGSNTVNWYQQLP GTAPKLLIYSNNQRPSGVPD RFSGSKSGTSASLAISGLQSE DEADYYCAAWDDSLNGPVF GGGTKVTVL | 2244 | EVOLVESGGGVVQPGRSLRL SCAASGFTFDDYAMHWVRQ PPGKGLEWVSGIDWNSGLIG YADAVKGRFTLSRDNAKNSI FLQMNSLRAEDTALYYCVK DMGSTGGYYGMDVWGQGT TVTVSS |
| 253 | 2245 | ELELTQPPSVSGTPGQRVTIS CSGSSSNIGSNTVNWYQHLP GTAPKLLIYSNNQRPSGVPD RFSGSKSGTSASLAISGLQSE DEADYYCAAWDDSLNGVVF GGGTKVTVL | 2246 | EVQLLESGGGLVQPGRTLRL SCAASGFTFDDYAMHWVRQ PPGKGLEWVSGIDWNSGLIG YADAVKGRFTLSRDNAKNSI FLQMNSLRAEDTALYYCVK DMGSTGGYYGMDVWGQGT TVTVSS |
| 254 | 2247 | ELELTQPPSVSVAPGKTARIT CGGNNIGSKSVHWYQQKPG QAPVLVIYYDSDRPSGIPERF SGSNSGNTATLTISRVEAGDE ADYYCQVWDSSSDHPVFGG GTELTVL | 2248 | QVQLVQSGGGLVQPGRSLRL SCAASGFTFDDYAMHWVRQ PPGKGLEWVSGIDWNSGLIG YADAVKGRFTLSRDNAKNSI FLQMNSLRAEDTALYYCVK DMGSTGGYYGMDVWGQGT TVTVSS |
| 255 | 2249 | ELMLTQPHSVSESPGKTVTIS CTRSSGSIASNYVQWYQQRP GSSPTTVIYEDNQRPSGVPDR FSGSIDSSSNSASLTISGLKTE DEADYYCQSYDSSNHAVFG GGTQLTVLG | 2250 | EVQLVESGGGLVQPGRSLRL SCAASGFTFDDYAMHWVRQ PPGKGLEWVSGIDWNSGLIG YADAVKGRFTLSRDNAKNSI FLQMNSLRAEDTALYYCVK DMGSTGGYYGMDVWGQGT TVTVSS |
| 256 | 2251 | ELELTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTKVTVL | 2252 | EVOLVESGGGLVQPGRTLRL SCAASGFTFDDYAMHWVRQ PPGKGLEWVSGIDWNSGLIG YADAVKGRFTLSRDNAKNSI FLQMNSLRAEDTALYYCVK DMGSTGGYYGMDVWGQGT TVTVSS |
| 257 | 2253 | ELELTQPPSVSGTPGQRVTIS CSGSSSNIGSNTVNWYQQLP GTAPKLLIYSNNQRPSGVPD RFSGSKSGTSASLAISGLQSE DEADYYCAAWDDSLNGVVF GGGTKVTVL | 2254 | EVQLLESGGGLVQPGRTLRL SCAASGFTFDDYAMHWVRQ PPGKGLEWVSGIDWNSGLIG YADAVKGRFTLSRDNAKNSI FLQMNSLRAEDTALYYCVK DMGSTGGYYGMDVWGQGT TVTVSS |
| 258 | 2255 | ELVVTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAVVFG GGTQLTVL | 2256 | EVOLVESGGGLVQPGRSLRL SCAASGFTFGDYAMHWVRQ PPGKGLEWVSGIDWNSGLIG YADAVKGRFTLSRDNAKNSI FLQMNSLRAEDTALYYCVK DMGSTGGYYGMDVWGQGT TVTVSS |
| 259 | 2257 | ELVLTQPPSASGTPGQRVTIS CSGSSSNIGSNTVNWYQQLP GTAPKLLIYSNNQRPSGVPD RFSGSKSGTSASLAISGLQSE DEADYYCAAWDDSLNGVVF GGGTKLTVL | 2258 | QVQLVQSGGGLVQPGRSLRL SCAASGFTFGDYAMHWVRQ APGKGLEWVSGIDWNSGLIG YADAVKGRFTLSRDNAKNSI FLQMNSLRAEDTALYYCVK DMGSTGGYYGMDVWGQGT TVTVSS |

TABLE 2-continued

| No. | SEQ: ID | LC variable region | SEQ: ID | HC variable region |
|---|---|---|---|---|
| 260 | 2259 | ELVLTQPPSASGTPGQRVTIS CSGSSSNIGSNTVNWYQQLP GTAPKLLIYTNNQRPSGVPD RFSGSKSGTSASLAISGLQSE DEADYYCAAWDDSLNGLVF GGGTELTVL | 2260 | EVOLVESGGGLVQPGRTLRL SCAASGFTFDDYAMHWVRQ PPGKGLEWVSGIDWNSGLIG YADAVKGRFTLSRDNAKNSI FLQMNSLRAEDTALYYCVK DMGSTGGYYGMDVWGQGT TVIVSS |
| 261 | 2261 | ELVVTQPPSVSAAPGQKVTIS CSGSSSNIGNNYVSWYQQLP GTAPKLLIYDNDKRPSGIPDR FSGSKSGTSATLGITGLQTGD EADYYCGTWDSSLSAYVFG TGTKVTVL | 2262 | EVQLLESGGGLVQPGRSLRL SCAASGFTFDDYAMHWVRQ PPGKGLEWVSGIDWNSGLIG YADAVKGRFTLSRDNAKNSI FLQMNSLRAEDTALYYCVK DMGSTGGYYGMDVWGQGT TVTVSS |
| 262 | 2263 | ELELTQPPSVSGTPGQRVTIS CSGSSSNIGSNTVNWYQQLP GTAPKLLIYSNNQRPSGVPD RFSGSKSGTSASLAISGLRSE DEADYYCQSYDSSLSGYVFG TGTKLTVL | 2264 | EVQLLESGGGLVQPGRTLRL SCAASGFTFDDYAMHWVRQ PPGKGLEWVSGIDWNSGLIG YADAVKGRFTLSRDNAKNSI FLQMNSLRAEDTALYYCVK DMGSTGGYYGMDVWGQGT TVTVSS |
| 263 | 2265 | ELVLTQPPSVSAAPGQKVTIS CSGSSPNIGNNYVSWYQQLP GTAPKLLIYDNNKRPSGIPDR FSGSKSGTSATLGITGLQTGD EADYYCGTWDSSLSAYVFG TGTKLTVL | 2266 | EVOLVESGGGLVQPGRTLRL SCAASGFTFDDYAMHWVRQ PPGKGLEWVSGIDWNSGLIG YADAVKGRFTLSRDNAKNSI FLQMNSLRAEDTALYYCVK DMGSTGGYYGMDVWGQGT TVTVSS |
| 264 | 2267 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAYVFG TGTKLTVL | 2268 | EVOLVESGGGLVQPGRTLRL SCAASGFTFDDYAMHWVRQ PPGKGLEWVSGIDWNSGLIG YADAVKGRFTLSRDNAKNSI FLQMNSLRAEDTALYYCVK DMGSTGGYYGMDVWGQGT TVTVSS |
| 265 | 2269 | ELVLTQPPSVSGAPGQRVTIS CTGSSSNIGAGYDVHWYQQL PGTAPKLLIYGNSNRPSGVPD RFSGSKSGTSASLAITGLQAE DEADYYCQSYDSSLSGVFGG GTQLTVL | 2270 | EVQLLESGGGLVQPGGSLRL SCAASGFTVSSNYMTWVRQ APGKGLEWVSVIYSGGSTFY ADSVKGRFTISRDNSKNTLY LQMNSLRAEDTAVYYCARD LVVYGMDVWGQGTTVTVSS |
| 266 | 2271 | ELELTQPPSVSVAPGKTARIT CGGNNIGSKSVHWYQQKPG QAPVLVIYYDSDRPSGIPERF SGSNSGNTATLTISRVEAGDE ADYYCQVRDSSSDHPVFGG GTKVTVL | 2272 | EVOLVESGGGLVQPGGSLRL SCAASGFTVSSNYMTWVRQ APGKGLEWVSVIYSGGSTFY ADSVKGRFTISRDNSKNTLY LQMNSLRAEDTAVYYCARD LVVYGMDVWGQGTTVTVSS |
| 267 | 2273 | ELELTQPPSVSGAPGQRVTIS CTGSSSNIGAGYDVHWYQQL PGTAPKLLIYGNSNRPSGVPD RFSGSKSGTSASLAITGLQAE DEADYYCQSYDSSLSGVFGG GTKVTVL | 2274 | EVOLVESGGGLVQPGGSLRL SCAASGFTVSSNYMTWVRQ APGKGLEWVSVIYSGGSTFY ADSVKGRFTISRDNSKNTLY LQMNSLRAEDTAVYYCARD LVVYGMDVWGQGTTVTVSS |
| 268 | 2275 | ELELTQPPSVSGAPGQRVTIS CTGSDSNIGAGYDVHWYQQ LPGTAPKLLIYNNNNRPSGVP DRFSGSKSGTSASLAITGLQA EDEADYFCQSSDSGLTGWVF GGGTKLTVL | 2276 | QVQLVQSGGGVVQPGRSLR LSCAASGFTVSSNYMTWVR QAPGKGLEWVSVIYSGGSTF YADSVKGRFTISRDNSKNTL YLQMNSLRAEDTAVYYCAR DLVVYGMDVWGQGTTVTVSS |
| 269 | 2277 | ELVVTQPPSASGTPGQRVTIS CSGSSSNIGSNTVNWYQQLP GTAPKLLIYSNNQRPSGVPD RFSGSKSGTSASLAIRGLRSE DEADYYCATWDDALSGWVF GGGTKLTVL | 2278 | QVQLVQSGGGVVQPGRSLR LSCAASGFTFSRFAMHWVRQ APGKGLEWVAVVSYDGSNN YYADSVKGRFTISRDNSKNT LYLQMNSLRAEDTAVYYCA RGDYYGSGSYYNPSPFFDYW GQGTLVTVSS |
| 270 | 2279 | ELVLTQSPGTLSLSPGERATL SCRASQSVSSYLAWYQQKPG QAPRLLIYDASNRATGIPARF SGSGSGTDFTLTISSLEPEDFA VYYCQQYGSSPLTFGGGTKV DIK | 2280 | QVQLVQSGGGLVQPGGSLRL SCAASGLTVSSNYMTWVRQ APGKGLEWVSVIYSGGSTFY ADSVKGRFTISRDNSKNTLY LQMNSLRAEDTAVYYCARD LVVYGMDVWGQGTTVTVSS |
| 271 | 2281 | ELELTQPPSASGTPGQRVTIS CSGSSSNIGSNTVNWYQQLP GTAPKLLIYSNNQRPSGVPD RFSGSKSGTSASLAISGLQSE DEADYYCSSYAGSNNLVFG GGTKLTVL | 2282 | EVOLVESGGGLVQPGGSLRL SCAASGFTVSSNYMTWVRQ APGKGLEWVSVIYSGGSTFY ADSVKGRFTISRDNSKNTLY LQMNSLRAEDTAVYYCARD LVVYGMDVWGQGTTVTVSS |

TABLE 2-continued

| No. | SEQ: ID | LC variable region | SEQ: ID | HC variable region |
|---|---|---|---|---|
| 272 | 2283 | ELVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKVTVL | 2284 | EVOLVESGGGLVQPGGSLRLSCAASGFTVSSNYMTWVRQAPGKGLEWVSVIYSGGSTFYADSVKGRFTISRDNSKNTLYLQMNSLRAEDTAVYYCARDLVVYGMDVWGQGTTVTVSS |
| 273 | 2285 | ELVLTQSPGTLSLSPGERATLSCRASQSVSSYLAWYQQKPGQAPRLLIYDASNRATGIPARFSGSGSGTDFTLTISSLEPEDFAVYYCQQYGSSPLTFGGGTKVDIK | 2286 | QVQLVQSGGGLVQPGGSLRLSCAASGLTVSSNYMTWVRQAPGKGLEWVSVIYSGGSTFYADSVKGRFTISRDNSKNTLYLQMNSLRAEDTAVYYCARDLVVYGMDVWGQGTTVTVSS |
| 274 | 2287 | ELELTQPPSVSGAPGQRVTISCTGSSSNIGAGYDVHWYQQLPGTAPKLLIYGNSNRPSGVPDRFSGSKSGTSASLAITGLQAEDEADYYCQSYDSSLGVVFGGGTKVTVL | 2288 | EVOLVESGGGLVQPGGSLRLSCAASGFTVSSNYMTWVRQAPGKGLEWVSVIYSGGSTFYADSVKGRFTISRDNSKNTLYLQMNSLRAEDTAVYYCARDLVVYGMDVWGQGTTVTVSS |
| 275 | 2289 | ELVLTQPPSVSVAPGKTARITCGGNNIGSNTVNWYQQLPGTAPKLLIYSNNLRPSGVPDRFSGSKSGTSASLAISGLQSEDEADYYCAAWDDSLNGPVFGGGTKVTVL | 2290 | EVOLVESGGGLVQPGGSLRLSCAASGFTVSSNYMTWVRQAPGKGLEWVSVIYSGGSTFYADSVKGRFTISRDNSKNTLYLQMNSLRAEDTAVYYCARDLVVYGMDVWGQGTTVTVSS |
| 276 | 2291 | ELELTQPPSASGAPGQRVTISCSGSSSNIGGSDVGWYQHLPGMAPRLLIYKSNQRPSGVPDRFSASKSGTSASLAISGLQSEDEGDYYCATWDDRLNWVFGGGTKVTVL | 2292 | QVQLVQSGGGLVQPGGSLRLSCAASGFTVSSNYMTWVRQAPGKGLEWVSVIYSGGSTFYADSVKGRFTISRDNSKNTLYLQMNSLRAEDTAVYYCARDLVVYGMDVWGQGTTVTVSS |
| 277 | 2293 | ELQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIK | 2294 | EVQLVQSGAEVKKPGASVKVSCKASGYTFTNYYMHWVRQAPGQGLEWMGIINPSGGSTSYAQKFQGRVTMTRDTSTSTVYMELSSLRSEDTAVYYCARGGIAPYTRGAFDYWGQGTLVTVSS |
| 278 | 2295 | ELQMTQSPSSLSASVGDRVTITCQAGQDISNYLNWYQQKPGKAPKLLIYKASSLESGVPSRFSGSGSGTDFTLTISSLQPEDFATYYCQQAHSFPFTFGPGTKVDIK | 2296 | EVOLVESGAEVKKPGASVKVSCKASGYTFTSYYMHWVRQAPGQGLEWMGIINPSGGSTSYAQKFQGRVTMTRDTSTSTVYMELSSLRSEDTAVYYCARGGIAPYTRGAFDYWGQGTLVTVSS |
| 279 | 2297 | ELTLTQSPSSLSASVGDRVTITCQASQDISNYLNWYQQKPGKAPKLLIYDASNLETGVPSRFSGSGSGTDFTLTISSLQPEDFATYYCQQSYSTLPTFGQGTRLEIK | 2298 | EVQLLESGAEVKKPGASVKVSCKASGYTFTSYYMHWVRQAPGQGLEWMGIINPSGGSTSYAQKFQGRVTMTRDTSTSTVYMELSSLRSEDTAVYYCARGGIAPYTRGAFDYWGQGTLVTVSS |
| 280 | 2299 | ELVLTQPPSVSGAPGQRVTISCTGSSSNTGAGYDVHWYQQLPGTAPKLLIYSNNQRPSGVPDRFSGSKSGTSASLAISGLQSEDEADYYCAAWDDSLNGGVFGGGTKVTVL | 2300 | EVOLVESGGGLVQPGGSLRLSCAASGITVSSNYMSWVRQAPGKGLEWVSVIYSGGSTNYADSVKGRFTISRDNSKNTLYLQMNSLRAEDTAVYYCARDLIVYGMDVWGQGTTVTVSS |
| 281 | 2301 | ELVLTQPPSVSGAPGQRVTISCTGSSSNIGAGYDVHWYQQLPGTAPKLLIYGNSNRPSGVPDRFSGSKSGTSASLAITGLQAEDEADYYCAAWDDSLSGWVFGGGTKVTVL | 2302 | QVQLVQSGGGLVQPGGSLRLSCAASGITVSSNYMSWVRQAPGKGLEWVSVIYSGGSTNYADSVKGRFTISRDNSKNTLYLQMNSLRAEDTAVYYCARDLIVYGMDVWGQGTTVTVSS |
| 282 | 2303 | ELVLTQPPSASGTPGQRVTISCSGSSSNIGAGYDVHWYQQLPGTAPKLLIYGNSNRPSGVPDRFSGSKSGTSASLAISGLQSEDEADYYCAAWDDSLNGGVFGGGTKVTVL | 2304 | EVOLVESGGGLVQPGGSLRLSCAASGITVSSNYMSWVRQAPGKGLEWVSVIYSGGSTNYADSVKGRFTISRDNSKNTLYLQMNSLRAEDTAVYYCARDLIVYGMDVWGQGTTVTVSS |
| 283 | 2305 | ELVMTQSPATLSLSPGERATLSCRASQSVSSYLAWYQQKPGQAPRLLIYDASNRATGIPARFSGSGSGTDFTLTISRLEPEDFAVYYCQQYGSSPPYTFGQGTKVDIK | 2306 | EVQLLESGGGLVQPGGSLRLSCAASGFTVSSNYMSWVRQAPGKGLEWVSVIYPGGSTYYADSVKGRFTISRDNSKNTLYLQMNSLRAEDTAVYYCARDLRGVLDYWGQGTLVTVSS |

TABLE 2-continued

| No. | SEQ: ID | LC variable region | SEQ: ID | HC variable region |
|---|---|---|---|---|
| 284 | 2307 | ELVLTQPPSVSAAPGQKVTIS CSGSSSNIGNNYVSWYQQLP GTAPKLLIYDNNKRPSGIPDR FSGSKSGTSATLGITGLQTGD EADYYCGTWDSSLSAGVFG GGTQLTVL | 2308 | QVQLVQSGGGLVQPGGSLRL SCAASGVTVSSNYMSWVRQ APGKGLEWVSVIYSGGSTYY ADSVKGRFTISRHNSKNTLY LQMNSLRAEDTAVYYCARG HVDIPYGMDVWGQGTTVTV SS |
| 285 | 2309 | ELELTQPPSVSGAPGQRVTIS CTGSSSNIGAGYDVHWYQQL PGTAPKLLIYGNSNRPSGVPD RFSGSKSGTSASLAITGLQAE DEADYYCQSYDSSLSGSVFG GGTKVTVL | 2310 | EVQLVQSGAEVKKPGSSVKV SCKASGGTFSSYAISWVRQA PGQGLEWMGRIIPILGIANYA QKFQGRVTITADKSTSTAYM ELSSLRSEDTAVYYCAREKG YSGSGSVNWFDPWGQGTLV TVSS |
| 286 | 2311 | ELVVTQPPSVSGAPGQRVTIS CTGSSSNIGAGYDVHWYQQL PGTAPKLLIYGNSNRPSGVPD RFSGSKSGTSASLAITGLQAE DEADYYCQSYDSSLSGSVFG GGTQLTVL | 2312 | QVQLVQSGAEVKKPGSSVK VSCKASGGTFSSYAISWVRQ APGQGLEWMGRIIPILGIANY AQKFQGRVTITADKSTSTAY MELSSLRSEDTAVYYCAREK GYSGSGSVNWFDPWGQGTL VTVPS |
| 287 | 2313 | ELVLTQPPSVSGAPGQRVTIS CTGSSSNIGAGYDVHWYQQL PGTAPKLLIYGNSNRPSGVPD RFSGSKSGTSASLAITGLQAE DEADYYCQSYDSSLSGSVFG GGTQLTVL | 2314 | QVQLVQSGAEVKKPGSSVK VSCKASGGTFSSYAISWVRQ APGQGLEWMGRIIPILGIANY AQKFQGRVTITADKSTSTAY MELSSLRSEDTAVYYCAREE ATTGINTNWFDPWGQGTLVT VSS |
| 288 | 2315 | ELMLTQPHSVSESPGKTVTIS CTRSSGSIASNYVQWYQQRP GSAPTTVIYEDNQRPSGVPD RFSGSIDSSSNSASLTISGLKT EDEADYYCQSYDSSNHWVF GGGTKVTVL | 2316 | QVQLVQSGGGVVQPGRSLR LSCAASGFTFSSYAMHWVR QAPGKGLEWVAVISYDGSN KYYADSVKGRFTISRDNSKN TLYLQMNSLRAEDTAVYYC ARANLGYCTNGVCAPSGGW GQGTLVTVSS |
| 289 | 2317 | ELVLTQPPSVSAAPGQKVTIS CSGGSSNIGNNYVSWYQQLP GTAPKLLIYDNNKRPSGIPDR FSGSKSGTSATLGITGLQTGD EADYYCGTWDSSLSAWVFG GGTKLTVL | 2318 | EVQLLESGGGLVQPGRSLRL SCAASGFTFGDYAMHWVRQ APGKGLEWVSGISWNSGRIG YADSVKGRFTISRDNAKNSL YLQMNSLRAEDTALYYCAK NLRYFDWLLGDDAFDIWGQ GTMVTVSS |
| 290 | 2319 | ELELTQPPSVSGAPGQRVTIS CTGSSSNIGAGYDVHWYQQL PGTAPKLLIYGNSNRPSGVPD RFSGSKSGTSASLAITGLQAE DEADYYCQSYDSSLSGSVFG GGTKLTVL | 2320 | EVQLVQSGGGLVQPGGSLRL SCAASGFTVSSNYMTWVRQ APGKGLEWVSVIYSGGSTFY ADSVKGRFTISRDNSKNTLY LQMNSLRAEDTAVYYCARD LVVYGMDVWGQGTTVTVSS |

In another embodiment of the present invention, the binding molecule includes a binding molecule having sequence identity of 80% to 99%, preferably 85 to 99%, and more preferably 90 to 99% to any one binding molecule selected from the group consisting of binding molecule Nos. 1, 2, 3, 4, 6, 7, 8, 9, 13, 14, 31, 44, 46, 47, 48, 49, 53, 55, 56, 65, 66, 69, 70, 71, 72, 79, 81, 83, 86, 88, 89, 90, 91, 93, 95, 103, 108, 113, 118, 128, 129, 139, 152, 195, 196, 197, 201, 203, 204, 205, 206, 207, 208, 209, 212, 213, 214, 215, 216, 217, 218, 219, 220, 221, 224, 230, 232, 235, 236, 239, 241, 242, 243, 244, 245, 246, 247, 249, 250, 251, 252, 254, 256, 259, 260, 261, 263, 265, 266, 268, 270, 271, 274, 275, 276, 278, 279, 280, 281, 283, 284, 285, 287, 288, 289 and 290 shown in Table 2, or at the same time, a binding molecule that achieves the purposes and effects of the present invention is included within the scope of the present invention.

Also, in another embodiment of the present invention, the binding molecule includes a binding molecule having sequence identity of 80% to 99%, preferably 85 to 99%, and more preferably 90 to 99% to any one binding molecule selected from the group consisting of binding molecule Nos. 89, 90, 91, 93, 95, 103, 108, 113, 118, 128, 129, 139, 152, 217, 218, 230, 260, 270, 271, 274, 275, 281 and 284 shown in Table 2, or at the same time, a binding molecule that achieves the purposes and effects of the present invention is included within the scope of the present invention.

Also, in another embodiment of the present invention, the binding molecule includes a binding molecule having sequence identity of 80% to 99%, preferably 85 to 99%, and more preferably 90 to 99% to any one binding molecule selected from the group consisting of binding molecule Nos. 91, 93, 103, 129, 139, 217, 260, 270, 275 and 284 shown in Table 2, or at the same time, a binding molecule that achieves the purposes and effects of the present invention is included within the scope of the present invention.

Also, in another embodiment of the present invention, the binding molecule includes a binding molecule having sequence identity of 80% to 99%, preferably 85 to 99%, and more preferably 90 to 99% to any one binding molecule selected from the group consisting of binding molecule Nos. 91, 93, 103, 129, 139 and 260 shown in Table 2, or at the same time, a binding molecule that achieves the purposes and effects of the present invention is included within the scope of the present invention.

Also, in another embodiment of the present invention, the binding molecule includes a binding molecule having sequence identity of 80% to 99%, preferably 85 to 99%, and more preferably 90 to 99% to any one binding molecule selected from the group consisting of binding molecule Nos. 91, 93, 103, 129 and 139 shown in Table 2, or at the same time, a binding molecule that achieves the purposes and effects of the present invention is included within the scope of the present invention.

Also, in another embodiment of the present invention, the binding molecule includes a binding molecule having sequence identity of 80% to 99%, preferably 85 to 99%, and more preferably 90 to 99%, to a binding molecule of No. 139 shown in Table 2, or at the same time, a binding molecule that achieves the purposes and effects of the present invention is included within the scope of the present invention.

In an embodiment of the present invention, the binding molecule may be a binding molecule comprising three light-chain CDR regions (LC CDR1, LC CDR2, and LC CDR3) contained in a light-chain (LC) variable region described in any one selected from the group consisting of SEQ ID NOS: 1741, 1743, 1745, 1747, 1749, 1751, 1753, 1755, 1757, 1759, 1761, 1763, 1765, 1767, 1769, 1771, 1773, 1775, 1777, 1779, 1781, 1783, 1785, 1787, 1789, 1791, 1793, 1795, 1797, 1799, 1801, 1803, 1805, 1807, 1809, 1811, 1813, 1815, 1817, 1819, 1821, 1823, 1825, 1827, 1829, 1831, 1833, 1835, 1837, 1839, 1841, 1843, 1845, 1847, 1849, 1851, 1853, 1855, 1857, 1859, 1861, 1863, 1865, 1867, 1869, 1871, 1873, 1875, 1877, 1879, 1881, 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, 2007, 2009, 2011, 2013, 2015, 2017, 2019, 2021, 2023, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, 2135, 2137, 2139, 2141, 2143, 2145, 2147, 2149, 2151, 2153, 2155, 2157, 2159, 2161, 2163, 2165, 2167, 2169, 2171, 2173, 2175, 2177, 2179, 2181, 2183, 2185, 2187, 2189, 2191, 2193, 2195, 2197, 2199, 2201, 2203, 2205, 2207, 2209, 2211, 2213, 2215, 2217, 2219, 2221, 2223, 2225, 2227, 2229, 2231, 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317 and 2319, and three heavy-chain CDR regions (HC CDR1, HC CDR2, and HC CDR3) contained in a heavy-chain (HC) variable region described in any one selected from the group consisting of SEQ ID NOS: 1742, 1744, 1746, 1748, 1750, 1752, 1754, 1756, 1758, 1760, 1762, 1764, 1766, 1768, 1770, 1772, 1774, 1776, 1778, 1780, 1782, 1784, 1786, 1788, 1790, 1792, 1794, 1796, 1798, 1800, 1802, 1804, 1806, 1808, 1810, 1812, 1814, 1816, 1818, 1820, 1822, 1824, 1826, 1828, 1830, 1832, 1834, 1836, 1838, 1840, 1842, 1844, 1846, 1848, 1850, 1852, 1854, 1856, 1858, 1860, 1862, 1864, 1866, 1868, 1870, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, 1984, 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 2132, 2134, 2136, 2138, 2140, 2142, 2144, 2146, 2148, 2150, 2152, 2154, 2156, 2158, 2160, 2162, 2164, 2166, 2168, 2170, 2172, 2174, 2176, 2178, 2180, 2182, 2184, 2186, 2188, 2190, 2192, 2194, 2196, 2198, 2200, 2202, 2204, 2206, 2208, 2210, 2212, 2214, 2216, 2218, 2220, 2222, 2224, 2226, 2228, 2230, 2232, 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, 2318 and 2320.

In another embodiment of the present invention, the binding molecule may be a binding molecule comprising three light-chain CDR regions (LC CDR1, LC CDR2, and LC CDR3) contained in a light-chain (LC) variable region described in any one selected from the group consisting of SEQ ID NOS: 1741, 1743, 1745, 1747, 1751, 1753, 1755, 1757, 1765, 1767, 1801, 1827, 1831, 1833, 1835, 1837, 1845, 1849, 1851, 1869, 1871, 1877, 1879, 1881, 1883, 1897, 1901, 1905, 1911, 1915, 1917, 1919, 1921, 1925, 1929, 1945, 1955, 1965, 1975, 1995, 1997, 2017, 2043, 2129, 2131, 2133, 2141, 2145, 2147, 2149, 2151, 2153, 2155, 2157, 2163, 2165, 2167, 2169, 2171, 2173, 2175, 2177, 2179, 2181, 2187, 2199, 2203, 2209, 2211, 2217, 2221, 2223, 2225, 2227, 2229, 2231, 2233, 2237, 2239, 2241, 2243, 2247, 2251, 2257, 2259, 2261, 2265, 2269, 2271, 2275, 2279, 2281, 2287, 2289, 2291, 2295, 2297, 2299, 2301, 2305, 2307, 2309, 2313, 2315, 2317 and 2319, and three heavy-chain CDR regions (HC CDR1, HC CDR2, and HC CDR3) contained in a heavy-chain (HC) variable region described in any one selected from the group consisting of SEQ ID NOS: 1742, 1744, 1746, 1748, 1752, 1754, 1756, 1758, 1766, 1768, 1802, 1828, 1832, 1834, 1836, 1838, 1846, 1850, 1852, 1870, 1872, 1878, 1880, 1882, 1884, 1898, 1902, 1906, 1912, 1916, 1918, 1920, 1922, 1926, 1930, 1946, 1956, 1966, 1976, 1996, 1998, 2018, 2044, 2130, 2132, 2134, 2142, 2146, 2148, 2150, 2152, 2154, 2156, 2158, 2164, 2166, 2168, 2170, 2172, 2174, 2176, 2178, 2180, 2182, 2188, 2200, 2204, 2210, 2212, 2218, 2222, 2224, 2226, 2228, 2230, 2232, 2234, 2238, 2240, 2242, 2244, 2248, 2252, 2258, 2260, 2262, 2266, 2270, 2272, 2276, 2280, 2282, 2288, 2290, 2292, 2296, 2298, 2300, 2302, 2306, 2308, 2310, 2314, 2316, 2318 and 2320.

In another embodiment of the present invention, the binding molecule may be a binding molecule comprising three light-chain CDR regions (LC CDR1, LC CDR2, and LC CDR3) contained in a light-chain (LC) variable region described in any one selected from the group consisting of SEQ ID NOS: 1917, 1919, 1921, 1925, 1929, 1945, 1955, 1965, 1975, 1995, 1997, 2017, 2043, 2173, 2175, 2199, 2259, 2279, 2281, 2287, 2289, 2301 and 2307, and three heavy-chain CDR regions (HC CDR1, HC CDR2, and HC CDR3) contained in a heavy-chain (HC) variable region described in any one selected from the group consisting of SEQ ID NOS: 1918, 1920, 1922, 1926, 1930, 1946, 1956, 1966, 1976, 1996, 1998, 2018, 2044, 2174, 2176, 2200, 2260, 2280, 2282, 2288, 2290, 2302 and 2308.

In another embodiment of the present invention, the binding molecule may be a binding molecule comprising three light-chain CDR regions (LC CDR1, LC CDR2, and LC CDR3) contained in a light-chain (LC) variable region described in any one selected from the group consisting of SEQ ID NOS: 1921, 1925, 1945, 1997, 2017, 2173, 2259, 2279, 2289 and 2307, and three heavy-chain CDR regions (HC CDR1, HC CDR2, and HC CDR3) contained in a heavy-chain (HC) variable region described in any one selected from the group consisting of SEQ ID NOS: 1922, 1926, 1946, 1998, 2018, 2174, 2260, 2280, 2290 and 2308.

In another embodiment of the present invention, the binding molecule may be a binding molecule comprising three light-chain CDR regions (LC CDR1, LC CDR2, and LC CDR3) contained in a light-chain (LC) variable region described in any one selected from the group consisting of SEQ ID NOS: 1921, 1925, 1945, 1997, 2017 and 2259, and three heavy-chain CDR regions (HC CDR1, HC CDR2, and HC CDR3) contained in a heavy-chain (HC) variable region described in any one selected from the group consisting of SEQ ID NOS: 1922, 1926, 1946, 1998, 2018 and 2260.

In another embodiment of the present invention, the binding molecule may be a binding molecule comprising three light-chain CDR regions (LC CDR1, LC CDR2, and LC CDR3) contained in a light-chain (LC) variable region described in any one selected from the group consisting of SEQ ID NOS: 1921, 1925, 1945, 1997 and 2017, and three heavy-chain CDR regions (HC CDR1, HC CDR2, and HC CDR3) contained in a heavy-chain (HC) variable region described in any one selected from the group consisting of SEQ ID NOS: 1922, 1926, 1946, 1998 and 2018.

In another embodiment of the present invention, the binding molecule may be a binding molecule comprising three light-chain CDR regions (LC CDR1, LC CDR2, and LC CDR3) contained in a light-chain (LC) variable region described in SEQ ID NO: 2017, and three heavy-chain CDR regions (HC CDR1, HC CDR2, and HC CDR3) contained in a heavy-chain (HC) variable region described in SEQ ID NO: 2018.

For example, the LC CDR1 may comprise any one selected from the group consisting of SEQ ID NOS: 1, 7, 13, 19, 25, 31, 37, 43, 49, 55, 61, 67, 73, 79, 85, 91, 97, 103, 109, 115, 121, 127, 133, 139, 145, 151, 157, 163, 169, 175, 181, 187, 193, 199, 205, 211, 217, 223, 229, 235, 241, 247, 253, 259, 265, 271, 277, 283, 289, 295, 301, 307, 313, 319, 325, 331, 337, 343, 349, 355, 361, 367, 373, 379, 385, 391, 397, 403, 409, 415, 421, 427, 433, 439, 445, 451, 457, 463, 469, 475, 481, 487, 493, 499, 505, 511, 517, 523, 529, 535, 541, 547, 553, 559, 565, 571, 577, 583, 589, 595, 601, 607, 613, 619, 625, 631, 637, 643, 649, 655, 661, 667, 673, 679, 685, 691, 697, 703, 709, 715, 721, 727, 733, 739, 745, 751, 757, 763, 769, 775, 781, 787, 793, 799, 805, 811, 817, 823, 829, 835, 841, 847, 853, 859, 865, 871, 877, 883, 889, 895, 901, 907, 913, 919, 925, 931, 937, 943, 949, 955, 961, 967, 973, 979, 985, 991, 997, 1003, 1009, 1015, 1021, 1027, 1033, 1039, 1045, 1051, 1057, 1063, 1069, 1075, 1081, 1087, 1093, 1099, 1105, 1111, 1117, 1123, 1129, 1135, 1141, 1147, 1153, 1159, 1165, 1171, 1177, 1183, 1189, 1195, 1201, 1207, 1213, 1219, 1225, 1231, 1237, 1243, 1249, 1255, 1261, 1267, 1273, 1279, 1285, 1291, 1297, 1303, 1309, 1315, 1321, 1327, 1333, 1339, 1345, 1351, 1357, 1363, 1369, 1375, 1381, 1387, 1393, 1399, 1405, 1411, 1417, 1423, 1429, 1435, 1441, 1447, 1453, 1459, 1465, 1471, 1477, 1483, 1489, 1495, 1501, 1507, 1513, 1519, 1525, 1531, 1537, 1543, 1549, 1555, 1561, 1567, 1573, 1579, 1585, 1591, 1597, 1603, 1609, 1615, 1621, 1627, 1633, 1639, 1645, 1651, 1657, 1663, 1669, 1675, 1681, 1687, 1693, 1699, 1705, 1711, 1717, 1723, 1729 and 1735, or a sequence derived therefrom, preferably comprises any one selected from the group consisting of SEQ ID NOS: 1, 7, 13, 19, 31, 37, 43, 49, 73, 79, 181, 259, 271, 277, 283, 289, 313, 325, 331, 385, 391, 409, 415, 421, 427, 469, 481, 493, 511, 523, 529, 535, 541, 553, 565, 613, 643, 673, 703, 763, 769, 829, 907, 1165, 1171, 1177, 1201, 1213, 1219, 1225, 1231, 1237, 1243, 1249, 1267, 1273, 1279, 1285, 1291, 1297, 1303, 1309, 1315, 1321, 1339, 1375, 1387, 1405, 1411, 1429, 1441, 1447, 1453, 1459, 1465, 1471, 1477, 1489, 1495, 1501, 1507, 1519, 1531, 1549, 1555, 1561, 1573, 1585, 1591, 1603, 1615, 1621, 1639, 1645, 1651, 1663, 1669, 1675, 1681, 1693, 1699, 1705, 1717, 1723, 1729 and 1735, or a sequence derived therefrom, more preferably comprises any one selected from the group consisting of SEQ ID NOS: 529, 535, 541, 553, 565, 613, 643, 673, 703, 763, 769, 829, 907, 1297, 1303, 1375, 1555, 1615, 1621, 1639, 1645, 1681 and 1699, or a sequence derived therefrom, more preferably comprises any one selected from the group consisting of SEQ ID NOS: 541, 553, 613, 769, 829, 1297, 1555, 1615, 1645 and 1699, or a sequence derived therefrom, more preferably comprises any one selected from the group consisting of SEQ ID NOS: 541, 553, 613, 769, 829 and 1555, or a sequence derived therefrom, and most preferably comprises any one selected from the group consisting of SEQ ID NOS: 541, 553, 613, 769 and 829, or a sequence derived therefrom.

The LC CDR2 may comprise any one selected from the group consisting of SEQ ID NOS: 2, 8, 14, 20, 26, 32, 38, 44, 50, 56, 62, 68, 74, 80, 86, 92, 98, 104, 110, 116, 122, 128, 134, 140, 146, 152, 158, 164, 170, 176, 182, 188, 194, 200, 206, 212, 218, 224, 230, 236, 242, 248, 254, 260, 266, 272, 278, 284, 290, 296, 302, 308, 314, 320, 326, 332, 338, 344, 350, 356, 362, 368, 374, 380, 386, 392, 398, 404, 410, 416, 422, 428, 434, 440, 446, 452, 458, 464, 470, 476, 482, 488, 494, 500, 506, 512, 518, 524, 530, 536, 542, 548, 554, 560, 566, 572, 578, 584, 590, 596, 602, 608, 614, 620, 626, 632, 638, 644, 650, 656, 662, 668, 674, 680, 686, 692, 698, 704, 710, 716, 722, 728, 734, 740, 746, 752, 758, 764, 770, 776, 782, 788, 794, 800, 806, 812, 818, 824, 830, 836, 842, 848, 854, 860, 866, 872, 878, 884, 890, 896, 902, 908, 914, 920, 926, 932, 938, 944, 950, 956, 962, 968, 974, 980, 986, 992, 998, 1004, 1010, 1016, 1022, 1028, 1034, 1040, 1046, 1052, 1058, 1064, 1070, 1076, 1082, 1088, 1094, 1100, 1106, 1112, 1118, 1124, 1130, 1136, 1142, 1148, 1154, 1160, 1166, 1172, 1178, 1184, 1190, 1196, 1202, 1208, 1214, 1220, 1226, 1232, 1238, 1244, 1250, 1256, 1262, 1268, 1274, 1280, 1286, 1292, 1298, 1304, 1310, 1316, 1322, 1328, 1334, 1340, 1346, 1352, 1358, 1364, 1370, 1376, 1382, 1388, 1394, 1400, 1406, 1412, 1418, 1424, 1430, 1436, 1442, 1448, 1454, 1460, 1466, 1472, 1478, 1484, 1490, 1496, 1502, 1508, 1514, 1520, 1526, 1532, 1538, 1544, 1550, 1556, 1562, 1568, 1574, 1580, 1586, 1592, 1598, 1604, 1610, 1616, 1622, 1628, 1634, 1640, 1646, 1652, 1658, 1664, 1670, 1676, 1682, 1688, 1694, 1700, 1706, 1712, 1718, 1724, 1730 and 1736, or a sequence derived therefrom, preferably comprises any one selected from the group consisting of SEQ ID NOS: 2, 8, 14, 20, 32, 38, 44, 50, 74, 80, 182, 260, 272, 278, 284, 290, 314, 326, 332, 386, 392, 410, 416, 422, 428, 470, 482, 494, 512, 524, 530, 536, 542, 554, 566, 614, 644, 674, 704, 764, 770, 830, 908, 1166, 1172, 1178, 1202, 1214, 1220, 1226, 1232, 1238, 1244, 1250, 1268, 1274, 1280, 1286, 1292, 1298, 1304, 1310, 1316, 1322, 1340, 1376, 1388, 1406, 1412, 1430, 1442, 1448, 1454, 1460, 1466, 1472, 1478, 1490, 1496, 1502, 1508, 1520, 1532, 1550, 1556, 1562, 1574, 1586, 1592, 1604, 1616, 1622, 1640, 1646, 1652, 1664, 1670, 1676, 1682, 1694, 1700, 1706, 1718, 1724, 1730 and 1736, or a sequence derived therefrom, more preferably comprises any one selected from the group consisting of SEQ ID NOS: 530, 536, 542, 554, 566, 614, 644, 674, 704, 764, 770, 830, 908, 1298, 1304, 1376, 1556, 1616, 1622, 1640, 1646, 1682 and 1700, or a sequence derived therefrom, more preferably comprises any one selected from the group consisting of SEQ ID NOS: 542, 554, 614, 770, 830, 1298, 1556, 1616, 1646 and 1700, or a sequence derived therefrom, more preferably comprises any one selected from the group consisting of SEQ ID NOS: 542, 554, 614, 770, 830 and 1556, or a sequence derived therefrom, and most preferably comprises any one selected from the group consisting of SEQ ID NOS: 542, 554, 614, 770 and 830, or a sequence derived therefrom.

The LC CDR3 may comprise any one selected from the group consisting of SEQ ID NOS: 3, 9, 15, 21, 27, 33, 39, 45, 51, 57, 63, 69, 75, 81, 87, 93, 99, 105, 111, 117, 123, 129, 135, 141, 147, 153, 159, 165, 171, 177, 183, 189, 195, 201, 207, 213, 219, 225, 231, 237, 243, 249, 255, 261, 267, 273, 279, 285, 291, 297, 303, 309, 315, 321, 327, 333, 339, 345, 351, 357, 363, 369, 375, 381, 387, 393, 399, 405, 411, 417, 423, 429, 435, 441, 447, 453, 459, 465, 471, 477, 483, 489, 495, 501, 507, 513, 519, 525, 531, 537, 543, 549, 555, 561, 567, 573, 579, 585, 591, 597, 603, 609, 615, 621, 627, 633, 639, 645, 651, 657, 663, 669, 675, 681, 687, 693, 699, 705, 711, 717, 723, 729, 735, 741, 747, 753, 759, 765, 771, 777, 783, 789, 795, 801, 807, 813, 819, 825, 831, 837, 843, 849, 855, 861, 867, 873, 879, 885, 891, 897, 903, 909, 915, 921, 927, 933, 939, 945, 951, 957, 963, 969, 975, 981, 987, 993, 999, 1005, 1011, 1017, 1023, 1029, 1035, 1041, 1047, 1053, 1059, 1065, 1071, 1077, 1083, 1089, 1095, 1101, 1107, 1113, 1119, 1125, 1131, 1137, 1143, 1149, 1155, 1161, 1167, 1173, 1179, 1185, 1191, 1197, 1203, 1209, 1215, 1221, 1227, 1233, 1239, 1245, 1251, 1257, 1263, 1269, 1275, 1281, 1287, 1293, 1299, 1305, 1311, 1317, 1323, 1329, 1335, 1341, 1347, 1353, 1359, 1365, 1371, 1377, 1383, 1389, 1395, 1401, 1407, 1413, 1419, 1425, 1431, 1437, 1443, 1449, 1455, 1461, 1467, 1473, 1479, 1485, 1491, 1497, 1503, 1509, 1515, 1521, 1527, 1533, 1539, 1545, 1551, 1557, 1563, 1569, 1575, 1581, 1587, 1593, 1599, 1605, 1611, 1617, 1623, 1629, 1635, 1641, 1647, 1653, 1659, 1665, 1671, 1677, 1683, 1689, 1695, 1701, 1707, 1713, 1719, 1725, 1731 and 1737, or a sequence derived therefrom, preferably comprises any one selected from the group consisting of SEQ ID NOS: 3, 9, 15, 21, 33, 39, 45, 51, 75, 81, 183, 261, 273, 279, 285, 291, 315, 327, 333, 387, 393, 411, 417, 423, 429, 471, 483, 495, 513, 525, 531, 537, 543, 555, 567, 615, 645, 675, 705, 765, 771, 831, 909, 1167, 1173, 1179, 1203, 1215, 1221, 1227, 1233, 1239, 1245, 1251, 1269, 1275, 1281, 1287, 1293, 1299, 1305, 1311, 1317, 1323, 1341, 1377, 1389, 1407, 1413, 1431, 1443, 1449, 1455, 1461, 1467, 1473, 1479, 1491, 1497, 1503, 1509, 1521, 1533, 1551, 1557, 1563, 1575, 1587, 1593, 1605, 1617, 1623, 1641, 1647, 1653, 1665, 1671, 1677, 1683, 1695, 1701, 1707, 1719, 1725, 1731 and 1737, or a sequence derived therefrom, more preferably comprises any one selected from the group consisting of SEQ ID NOS: 531, 537, 543, 555, 567, 615, 645, 675, 705, 765, 771, 831, 909, 1299, 1305, 1377, 1557, 1617, 1623, 1641, 1647, 1683 and 1701, or a sequence derived therefrom, more preferably comprises any one selected from the group consisting of SEQ ID NOS: 543, 555, 615, 771, 831, 1299, 1557, 1617, 1647 and 1701, or a sequence derived therefrom, more preferably comprises any one selected from the group consisting of SEQ ID NOS: 543, 555, 615, 771, 831 and 1557, or a sequence derived therefrom, and most preferably comprises any one selected from the group consisting of SEQ ID NOS: 543, 555, 615, 771 and 831, or a sequence derived therefrom.

The HC CDR1 may comprise any one selected from the group consisting of SEQ ID NOS: 4, 10, 16, 22, 28, 34, 40, 46, 52, 58, 64, 70, 76, 82, 88, 94, 100, 106, 112, 118, 124, 130, 136, 142, 148, 154, 160, 166, 172, 178, 184, 190, 196, 202, 208, 214, 220, 226, 232, 238, 244, 250, 256, 262, 268, 274, 280, 286, 292, 298, 304, 310, 316, 322, 328, 334, 340, 346, 352, 358, 364, 370, 376, 382, 388, 394, 400, 406, 412, 418, 424, 430, 436, 442, 448, 454, 460, 466, 472, 478, 484, 490, 496, 502, 508, 514, 520, 526, 532, 538, 544, 550, 556, 562, 568, 574, 580, 586, 592, 598, 604, 610, 616, 622, 628, 634, 640, 646, 652, 658, 664, 670, 676, 682, 688, 694, 700, 706, 712, 718, 724, 730, 736, 742, 748, 754, 760, 766, 772, 778, 784, 790, 796, 802, 808, 814, 820, 826, 832, 838, 844, 850, 856, 862, 868, 874, 880, 886, 892, 898, 904, 910, 916, 922, 928, 934, 940, 946, 952, 958, 964, 970, 976, 982, 988, 994, 1000, 1006, 1012, 1018, 1024, 1030, 1036, 1042, 1048, 1054, 1060, 1066, 1072, 1078, 1084, 1090, 1096, 1102, 1108, 1114, 1120, 1126, 1132, 1138, 1144, 1150, 1156, 1162, 1168, 1174, 1180, 1186, 1192, 1198, 1204, 1210, 1216, 1222, 1228, 1234, 1240, 1246, 1252, 1258, 1264, 1270, 1276, 1282, 1288, 1294, 1300, 1306, 1312, 1318, 1324, 1330, 1336, 1342, 1348, 1354, 1360, 1366, 1372, 1378, 1384, 1390, 1396, 1402, 1408, 1414, 1420, 1426, 1432, 1438, 1444, 1450, 1456, 1462, 1468, 1474, 1480, 1486, 1492, 1498, 1504, 1510, 1516, 1522, 1528, 1534, 1540, 1546, 1552, 1558, 1564, 1570, 1576, 1582, 1588, 1594, 1600, 1606, 1612, 1618, 1624, 1630, 1636, 1642, 1648, 1654, 1660, 1666, 1672, 1678, 1684, 1690, 1696, 1702, 1708, 1714, 1720, 1726, 1732 and 1738, or a sequence derived therefrom, preferably comprises any one selected from the group consisting of SEQ ID NOS: 4, 10, 16, 22, 34, 40, 46, 52, 76, 82, 184, 262, 274, 280, 286, 292, 316, 328, 334, 388, 394, 412, 418, 424, 430, 472, 484, 496, 514, 526, 532, 538, 544, 556, 568, 616, 646, 676, 706, 766, 772, 832, 910, 1168, 1174, 1180, 1204, 1216, 1222, 1228, 1234, 1240, 1246, 1252, 1270, 1276, 1282, 1288, 1294, 1300, 1306, 1312, 1318, 1324, 1342, 1378, 1390, 1408, 1414, 1432, 1444, 1450, 1456, 1462, 1468, 1474, 1480, 1492, 1498, 1504, 1510, 1522, 1534, 1552, 1558, 1564, 1576, 1588, 1594, 1606, 1618, 1624, 1642, 1648, 1654, 1666, 1672, 1678, 1684, 1696, 1702, 1708, 1720, 1726, 1732 and 1738, or a sequence derived therefrom, more preferably comprises any one selected from the group consisting of SEQ ID NOS: 532, 538, 544, 556, 568, 616, 646, 676, 706, 766, 772, 832, 910, 1300, 1306, 1378, 1558, 1618, 1624, 1642, 1648, 1684 and 1702, or a sequence derived therefrom, more preferably comprises any one selected from the group consisting of SEQ ID NOS: 544, 556, 616, 772, 832, 1300, 1558, 1618, 1648 and 1702, or a sequence derived therefrom, more preferably comprises any one selected from the group consisting of SEQ ID NOS: 544, 556, 616, 772, 832 and 1558, or a sequence derived therefrom, and most preferably comprises any one selected from the group consisting of SEQ ID NOS: 544, 556, 616, 772 and 832, or a sequence derived therefrom.

The HC CDR2 may comprise any one selected from the group consisting of SEQ ID NOS: 5, 11, 17, 23, 29, 35, 41, 47, 53, 59, 65, 71, 77, 83, 89, 95, 101, 107, 113, 119, 125, 131, 137, 143, 149, 155, 161, 167, 173, 179, 185, 191, 197, 203, 209, 215, 221, 227, 233, 239, 245, 251, 257, 263, 269, 275, 281, 287, 293, 299, 305, 311, 317, 323, 329, 335, 341, 347, 353, 359, 365, 371, 377, 383, 389, 395, 401, 407, 413, 419, 425, 431, 437, 443, 449, 455, 461, 467, 473, 479, 485, 491, 497, 503, 509, 515, 521, 527, 533, 539, 545, 551, 557, 563, 569, 575, 581, 587, 593, 599, 605, 611, 617, 623, 629, 635, 641, 647, 653, 659, 665, 671, 677, 683, 689, 695, 701, 707, 713, 719, 725, 731, 737, 743, 749, 755, 761, 767, 773, 779, 785, 791, 797, 803, 809, 815, 821, 827, 833, 839, 845, 851, 857, 863, 869, 875, 881, 887, 893, 899, 905, 911, 917, 923, 929, 935, 941, 947, 953, 959, 965, 971, 977, 983, 989, 995, 1001, 1007, 1013, 1019, 1025, 1031, 1037, 1043, 1049, 1055, 1061, 1067, 1073, 1079, 1085, 1091, 1097, 1103, 1109, 1115, 1121, 1127, 1133, 1139, 1145, 1151, 1157, 1163, 1169, 1175, 1181, 1187, 1193, 1199, 1205, 1211, 1217, 1223, 1229, 1235, 1241, 1247, 1253, 1259, 1265, 1271, 1277, 1283, 1289, 1295, 1301, 1307, 1313, 1319, 1325, 1331, 1337, 1343, 1349, 1355, 1361, 1367, 1373, 1379, 1385, 1391, 1397, 1403, 1409, 1415, 1421, 1427, 1433, 1439, 1445, 1451, 1457, 1463, 1469, 1475, 1481, 1487, 1493, 1499, 1505, 1511, 1517, 1523, 1529, 1535, 1541, 1547, 1553, 1559, 1565, 1571, 1577, 1583, 1589, 1595, 1601, 1607, 1613, 1619, 1625, 1631, 1637, 1643, 1649, 1655, 1661, 1667, 1673, 1679, 1685, 1691, 1697, 1703, 1709, 1715, 1721, 1727, 1733 and 1739, or a sequence derived therefrom, preferably comprises any one selected from the group consisting of SEQ ID NOS: 5, 11, 17, 23, 35, 41, 47, 53, 77, 83, 185, 263, 275, 281, 287, 293, 317, 329, 335, 389, 395, 413, 419, 425, 431, 473, 485, 497, 515, 527, 533, 539, 545, 557, 569, 617, 647, 677, 707, 767, 773, 833, 911, 1169, 1175, 1181, 1205, 1217, 1223, 1229, 1235, 1241, 1247, 1253, 1271, 1277, 1283, 1289, 1295, 1301, 1307, 1313, 1319, 1325, 1343, 1379, 1391, 1409, 1415, 1433, 1445, 1451, 1457, 1463, 1469, 1475, 1481, 1493, 1499, 1505, 1511, 1523, 1535, 1553, 1559, 1565, 1577, 1589, 1595, 1607, 1619, 1625, 1643, 1649, 1655, 1667, 1673, 1679, 1685, 1697, 1703, 1709, 1721, 1727, 1733 and 1739, or a sequence derived therefrom, more preferably comprises any one selected from the group consisting of SEQ ID NOS: 533, 539, 545, 557, 569, 617, 647, 677, 707, 767, 773, 833, 911, 1301, 1307, 1379, 1559, 1619, 1625, 1643, 1649, 1685 and 1703, or a sequence derived therefrom, more preferably comprises any one selected from the group consisting of SEQ ID NOS: 545, 557, 617, 773, 833, 1301, 1559, 1619, 1649 and 1703, or a sequence derived therefrom, more preferably comprises any one selected from the group consisting of SEQ ID NOS: 545, 557, 617, 773, 833 and 1559, or a sequence derived therefrom, and most preferably comprises any one selected from the group consisting of SEQ ID NOS: 545, 557, 617, 773 and 833, or a sequence derived therefrom.

The HC CDR3 may comprise any one selected from the group consisting of SEQ ID NOS: 6, 12, 18, 24, 30, 36, 42, 48, 54, 60, 66, 72, 78, 84, 90, 96, 102, 108, 114, 120, 126, 132, 138, 144, 150, 156, 162, 168, 174, 180, 186, 192, 198, 204, 210, 216, 222, 228, 234, 240, 246, 252, 258, 264, 270, 276, 282, 288, 294, 300, 306, 312, 318, 324, 330, 336, 342, 348, 354, 360, 366, 372, 378, 384, 390, 396, 402, 408, 414, 420, 426, 432, 438, 444, 450, 456, 462, 468, 474, 480, 486, 492, 498, 504, 510, 516, 522, 528, 534, 540, 546, 552, 558, 564, 570, 576, 582, 588, 594, 600, 606, 612, 618, 624, 630, 636, 642, 648, 654, 660, 666, 672, 678, 684, 690, 696, 702, 708, 714, 720, 726, 732, 738, 744, 750, 756, 762, 768, 774, 780, 786, 792, 798, 804, 810, 816, 822, 828, 834, 840, 846, 852, 858, 864, 870, 876, 882, 888, 894, 900, 906, 912, 918, 924, 930, 936, 942, 948, 954, 960, 966, 972, 978, 984, 990, 996, 1002, 1008, 1014, 1020, 1026, 1032, 1038, 1044, 1050, 1056, 1062, 1068, 1074, 1080, 1086, 1092, 1098, 1104, 1110, 1116, 1122, 1128, 1134, 1140, 1146, 1152, 1158, 1164, 1170, 1176, 1182, 1188, 1194, 1200, 1206, 1212, 1218, 1224, 1230, 1236, 1242, 1248, 1254, 1260, 1266, 1272, 1278, 1284, 1290, 1296, 1302, 1308, 1314, 1320, 1326, 1332, 1338, 1344, 1350, 1356, 1362, 1368, 1374, 1380, 1386, 1392, 1398, 1404, 1410, 1416, 1422, 1428, 1434, 1440, 1446, 1452, 1458, 1464, 1470, 1476, 1482, 1488, 1494, 1500, 1506, 1512, 1518, 1524, 1530, 1536, 1542, 1548, 1554, 1560, 1566, 1572, 1578, 1584, 1590, 1596, 1602, 1608, 1614, 1620, 1626, 1632, 1638, 1644, 1650, 1656, 1662, 1668, 1674, 1680, 1686, 1692, 1698, 1704, 1710, 1716, 1722, 1728, 1734 and 1740, or a sequence derived therefrom, preferably comprises any one selected from the group consisting of SEQ ID NOS: 6, 12, 18, 24, 36, 42, 48, 54, 78, 84, 186, 264, 276, 282, 288, 294, 318, 330, 336, 390, 396, 414, 420, 426, 432, 474, 486, 498, 516, 528, 534, 540, 546, 558, 570, 618, 648, 678, 708, 768, 774, 834, 912, 1170, 1176, 1182, 1206, 1218, 1224, 1230, 1236, 1242, 1248, 1254, 1272, 1278, 1284, 1290, 1296, 1302, 1308, 1314, 1320, 1326, 1344, 1380, 1392, 1410, 1416, 1434, 1446, 1452, 1458, 1464, 1470, 1476, 1482, 1494, 1500, 1506, 1512, 1524, 1536, 1554, 1560, 1566, 1578, 1590, 1596, 1608, 1620, 1626, 1644, 1650, 1656, 1668, 1674, 1680, 1686, 1698, 1704, 1710, 1722, 1728, 1734 and 1740, or a sequence derived therefrom, more preferably comprises any one selected from the group consisting of SEQ ID NOS: 534, 540, 546, 558, 570, 618, 648, 678, 708, 768, 774, 834, 912, 1302, 1308, 1380, 1560, 1620, 1626, 1644, 1650, 1686 and 1704, or a sequence derived therefrom, more preferably comprises any one selected from the group consisting of SEQ ID NOS: 546, 558, 618, 774, 834, 1302, 1560, 1620, 1650 and 1704, or a sequence derived therefrom, more preferably comprises any one selected from the group consisting of SEQ ID NOS: 546, 558, 618, 774, 834 and 1560, or a sequence derived therefrom, and most preferably comprises any one selected from the group consisting of SEQ ID NOS: 546, 558, 618, 774 and 834, or a sequence derived therefrom.

In an embodiment of the present invention, the binding molecule includes, as a binding molecule that binds to a spike protein (S protein) on the surface of SARS-coronavirus-2 (SARS-CoV-2), a binding molecule that competes with any one binding molecule selected from the group consisting of binding molecules 1) to 290) below, or at the same time, a binding molecule that achieves the purposes and effects of the present invention is included within the scope of the present invention:

1) a binding molecule comprising a) a light-chain variable region comprising a CDR1 region of SEQ ID NO: 1, a CDR2 region of SEQ ID NO: 2, and a CDR3 region of SEQ ID NO: 3, and b) a heavy-chain variable region comprising a CDR1 region of SEQ ID NO: 4, a CDR2 region of SEQ ID NO: 5, and a CDR3 region of SEQ ID NO: 6;

2) a binding molecule comprising a) a light-chain variable region comprising a CDR1 region of SEQ ID NO: 7, a CDR2 region of SEQ ID NO: 8, and a CDR3 region of SEQ ID NO: 9, and b) a heavy-chain variable region comprising a CDR1 region of SEQ ID NO: 10, a CDR2 region of SEQ ID NO: 11, and a CDR3 region of SEQ ID NO: 12;

3) a binding molecule comprising a) a light-chain variable region comprising a CDR1 region of SEQ ID NO: 13, a CDR2 region of SEQ ID NO: 14, and a CDR3 region of SEQ ID NO: 15, and b) a heavy-chain variable region comprising a CDR1 region of SEQ ID NO: 16, a CDR2 region of SEQ ID NO: 17, and a CDR3 region of SEQ ID NO: 18;

4) a binding molecule comprising a) a light-chain variable region comprising a CDR1 region of SEQ ID NO: 19, a CDR2 region of SEQ ID NO: 20, and a CDR3 region of SEQ ID NO: 21, and b) a heavy-chain variable region comprising a CDR1 region of SEQ ID NO: 22, a CDR2 region of SEQ ID NO: 23, and a CDR3 region of SEQ ID NO: 24;

5) a binding molecule comprising a) a light-chain variable region comprising a CDR1 region of SEQ ID NO: 25, a CDR2 region of SEQ ID NO: 26, and a CDR3 region of SEQ ID NO: 27, and b) a heavy-chain variable region comprising a CDR1 region of SEQ ID NO: 28, a CDR2 region of SEQ ID NO: 29, and a CDR3 region of SEQ ID NO: 30;

6) a binding molecule comprising a) a light-chain variable region comprising a CDR1 region of SEQ ID NO: 31, a CDR2 region of SEQ ID NO: 32, and a CDR3 region of SEQ ID NO: 33, and b) a heavy-chain variable region comprising a CDR1 region of SEQ ID NO: 34, a CDR2 region of SEQ ID NO: 35, and a CDR3 region of SEQ ID NO: 36;

7) a binding molecule comprising a) a light-chain variable region comprising a CDR1 region of SEQ ID NO: 37, a CDR2 region of SEQ ID NO: 38, and a CDR3 region of SEQ ID NO: 39, and b) a heavy-chain variable region comprising a CDR1 region of SEQ ID NO: 40, a CDR2 region of SEQ ID NO: 41, and a CDR3 region of SEQ ID NO: 42;

8) a binding molecule comprising a) a light-chain variable region comprising a CDR1 region of SEQ ID NO: 43, a CDR2 region of SEQ ID NO: 44, and a CDR3 region of SEQ ID NO: 45, and b) a heavy-chain variable region comprising a CDR1 region of SEQ ID NO: 46, a CDR2 region of SEQ ID NO: 47, and a CDR3 region of SEQ ID NO: 48;

9) a binding molecule comprising a) a light-chain variable region comprising a CDR1 region of SEQ ID NO: 49, a CDR2 region of SEQ ID NO: 50, and a CDR3 region of SEQ ID NO: 51, and b) a heavy-chain variable region comprising a CDR1 region of SEQ ID NO: 52, a CDR2 region of SEQ ID NO: 53, and a CDR3 region of SEQ ID NO: 54;

10) a binding molecule comprising a) a light-chain variable region comprising a CDR1 region of SEQ ID NO: 55, a CDR2 region of SEQ ID NO: 56, and a CDR3 region of SEQ ID NO: 57, and b) a heavy-chain variable region comprising a CDR1 region of SEQ ID NO: 58, a CDR2 region of SEQ ID NO: 59, and a CDR3 region of SEQ ID NO: 60;

11) a binding molecule comprising a) a light-chain variable region comprising a CDR1 region of SEQ ID NO: 61, a CDR2 region of SEQ ID NO: 62, and a CDR3 region of SEQ ID NO: 63, and b) a heavy-chain variable region comprising a CDR1 region of SEQ ID NO: 64, a CDR2 region of SEQ ID NO: 65, and a CDR3 region of SEQ ID NO: 66;

12) a binding molecule comprising a) a light-chain variable region comprising a CDR1 region of SEQ ID NO: 67, a CDR2 region of SEQ ID NO: 68, and a CDR3 region of SEQ ID NO: 69, and b) a heavy-chain variable region comprising a CDR1 region of SEQ ID NO: 70, a CDR2 region of SEQ ID NO: 71, and a CDR3 region of SEQ ID NO: 72;

13) a binding molecule comprising a) a light-chain variable region comprising a CDR1 region of SEQ ID NO: 73, a CDR2 region of SEQ ID NO: 74, and a CDR3 region of SEQ ID NO: 75, and b) a heavy-chain variable region comprising a CDR1 region of SEQ ID NO: 76, a CDR2 region of SEQ ID NO: 77, and a CDR3 region of SEQ ID NO: 78;

14) a binding molecule comprising a) a light-chain variable region comprising a CDR1 region of SEQ ID NO: 79, a CDR2 region of SEQ ID NO: 80, and a CDR3 region of SEQ ID NO: 81, and b) a heavy-chain variable region comprising a CDR1 region of SEQ ID NO: 82, a CDR2 region of SEQ ID NO: 83, and a CDR3 region of SEQ ID NO: 84;

15) a binding molecule comprising a) a light-chain variable region comprising a CDR1 region of SEQ ID NO: 85, a CDR2 region of SEQ ID NO: 86, and a CDR3 region of SEQ ID NO: 87, and b) a heavy-chain variable region comprising a CDR1 region of SEQ ID NO: 88, a CDR2 region of SEQ ID NO: 89, and a CDR3 region of SEQ ID NO: 90;

16) a binding molecule comprising a) a light-chain variable region comprising a CDR1 region of SEQ ID NO: 91, a CDR2 region of SEQ ID NO: 92, and a CDR3 region of SEQ ID NO: 93, and b) a heavy-chain variable region comprising a CDR1 region of SEQ ID NO: 94, a CDR2 region of SEQ ID NO: 95, and a CDR3 region of SEQ ID NO: 96;

17) a binding molecule comprising a) a light-chain variable region comprising a CDR1 region of SEQ ID NO: 97, a CDR2 region of SEQ ID NO: 98, and a CDR3 region of SEQ ID NO: 99, and b) a heavy-chain variable region comprising a CDR1 region of SEQ ID NO: 100, a CDR2 region of SEQ ID NO: 101, and a CDR3 region of SEQ ID NO: 102;

18) a binding molecule comprising a) a light-chain variable region comprising a CDR1 region of SEQ ID NO: 103, a CDR2 region of SEQ ID NO: 104, and a CDR3 region of SEQ ID NO: 105, and b) a heavy-chain variable region comprising a CDR1 region of SEQ ID NO: 106, a CDR2 region of SEQ ID NO: 107, and a CDR3 region of SEQ ID NO: 108;

19) a binding molecule comprising a) a light-chain variable region comprising a CDR1 region of SEQ ID NO: 109, CDR2 region of SEQ ID NO: 110, and CDR3 region of SEQ ID NO: 111, and b) a heavy-chain variable region comprising a CDR1 region of SEQ ID NO: 112, a CDR2 region of SEQ ID NO: 113, and a CDR3 region of SEQ ID NO: 114;

20) a binding molecule comprising a) a light-chain variable region comprising a CDR1 region of SEQ ID NO: 115, a CDR2 region of SEQ ID NO: 116, and a CDR3 region of SEQ ID NO: 117, and b) a heavy-chain variable region comprising a CDR1 region of SEQ ID NO: 118, a CDR2 region of SEQ ID NO: 119, and a CDR3 region of SEQ ID NO: 120;
21) a binding molecule comprising a) a light-chain variable region comprising a CDR1 region of SEQ ID NO: 121, a CDR2 region of SEQ ID NO: 122, and a CDR3 region of SEQ ID NO: 123, and b) a heavy-chain variable region comprising a CDR1 region of SEQ ID NO: 124, a CDR2 region of SEQ ID NO: 125, and a CDR3 region of SEQ ID NO: 126;
22) a binding molecule comprising a) a light-chain variable region comprising a CDR1 region of SEQ ID NO: 127, a CDR2 region of SEQ ID NO: 128, and a CDR3 region of SEQ ID NO: 129, and b) a heavy-chain variable region comprising a CDR1 region of SEQ ID NO: 130, a CDR2 region of SEQ ID NO: 131, and a CDR3 region of SEQ ID NO: 132;
23) a binding molecule comprising a) a light-chain variable region comprising a CDR1 region of SEQ ID NO: 133, a CDR2 region of SEQ ID NO: 134, and a CDR3 region of SEQ ID NO: 135, and b) a heavy-chain variable region comprising a CDR1 region of SEQ ID NO: 136, a CDR2 region of SEQ ID NO: 137, and a CDR3 region of SEQ ID NO: 138;
24) a binding molecule comprising a) a light-chain variable region comprising a CDR1 region of SEQ ID NO: 139, a CDR2 region of SEQ ID NO: 140, and a CDR3 region of SEQ ID NO: 141, and b) a heavy-chain variable region comprising a CDR1 region of SEQ ID NO: 142, a CDR2 region of SEQ ID NO: 143, and a CDR3 region of SEQ ID NO: 144;
25) a binding molecule comprising a) a light-chain variable region comprising a CDR1 region of SEQ ID NO: 145, a CDR2 region of SEQ ID NO: 146, and a CDR3 region of SEQ ID NO: 147, and b) a heavy-chain variable region comprising a CDR1 region of SEQ ID NO: 148, a CDR2 region of SEQ ID NO: 149, and a CDR3 region of SEQ ID NO: 150;
26) a binding molecule comprising a) a light-chain variable region comprising a CDR1 region of SEQ ID NO: 151, a CDR2 region of SEQ ID NO: 152, and a CDR3 region of SEQ ID NO: 153, and b) a heavy-chain variable region comprising a CDR1 region of SEQ ID NO: 154, a CDR2 region of SEQ ID NO: 155, and a CDR3 region of SEQ ID NO: 156;
27) a binding molecule comprising a) a light-chain variable region comprising a CDR1 region of SEQ ID NO: 157, a CDR2 region of SEQ ID NO: 158, and a CDR3 region of SEQ ID NO: 159, and b) a heavy-chain variable region comprising a CDR1 region of SEQ ID NO: 160, a CDR2 region of SEQ ID NO: 161, and a CDR3 region of SEQ ID NO: 162;
28) a binding molecule comprising a) a light-chain variable region comprising a CDR1 region of SEQ ID NO: 163, a CDR2 region of SEQ ID NO: 164, and a CDR3 region of SEQ ID NO: 165, and b) a heavy-chain variable region comprising a CDR1 region of SEQ ID NO: 166, a CDR2 region of SEQ ID NO: 167, and a CDR3 region of SEQ ID NO: 168;
29) a binding molecule comprising a) a light-chain variable region comprising a CDR1 region of SEQ ID NO: 169, a CDR2 region of SEQ ID NO: 170, and a CDR3 region of SEQ ID NO: 171, and b) a heavy-chain variable region comprising a CDR1 region of SEQ ID NO: 172, a CDR2 region of SEQ ID NO: 173, and a CDR3 region of SEQ ID NO: 174;
30) a binding molecule comprising a) a light-chain variable region comprising a CDR1 region of SEQ ID NO: 175, a CDR2 region of SEQ ID NO: 176, and a CDR3 region of SEQ ID NO: 177, and b) a heavy-chain variable region comprising a CDR1 region of SEQ ID NO: 178, a CDR2 region of SEQ ID NO: 179, and a CDR3 region of SEQ ID NO: 180;
31) a binding molecule comprising a) a light-chain variable region comprising a CDR1 region of SEQ ID NO: 181, a CDR2 region of SEQ ID NO: 182, and a CDR3 region of SEQ ID NO: 183, and b) a heavy-chain variable region comprising a CDR1 region of SEQ ID NO: 184, a CDR2 region of SEQ ID NO: 185, and a CDR3 region of SEQ ID NO: 186;
32) a binding molecule comprising a) a light-chain variable region comprising a CDR1 region of SEQ ID NO: 187, a CDR2 region of SEQ ID NO: 188, and a CDR3 region of SEQ ID NO: 189, and b) a heavy-chain variable region comprising a CDR1 region of SEQ ID NO: 190, a CDR2 region of SEQ ID NO: 191, and a CDR3 region of SEQ ID NO: 192;
33) a binding molecule comprising a) a light-chain variable region comprising a CDR1 region of SEQ ID NO: 193, a CDR2 region of SEQ ID NO: 194, and a CDR3 region of SEQ ID NO: 195, and b) a heavy-chain variable region comprising a CDR1 region of SEQ ID NO: 196, a CDR2 region of SEQ ID NO: 197, and a CDR3 region of SEQ ID NO: 198;
34) a binding molecule comprising a) a light-chain variable region comprising a CDR1 region of SEQ ID NO: 199, a CDR2 region of SEQ ID NO: 200, and a CDR3 region of SEQ ID NO: 201, and b) a heavy-chain variable region comprising a CDR1 region of SEQ ID NO: 202, a CDR2 region of SEQ ID NO: 203, and a CDR3 region of SEQ ID NO: 204;
35) a binding molecule comprising a) a light-chain variable region comprising a CDR1 region of SEQ ID NO: 205, a CDR2 region of SEQ ID NO: 206, and a CDR3 region of SEQ ID NO: 207, and b) a heavy-chain variable region comprising a CDR1 region of SEQ ID NO: 208, a CDR2 region of SEQ ID NO: 209, and a CDR3 region of SEQ ID NO: 210;
36) a binding molecule comprising a) a light-chain variable region comprising a CDR1 region of SEQ ID NO: 211, a CDR2 region of SEQ ID NO: 212, and a CDR3 region of SEQ ID NO: 213, and b) a heavy-chain variable region comprising a CDR1 region of SEQ ID NO: 214, a CDR2 region of SEQ ID NO: 215, and a CDR3 region of SEQ ID NO: 216;
37) a binding molecule comprising a) a light-chain variable region comprising a CDR1 region of SEQ ID NO: 217, a CDR2 region of SEQ ID NO: 218, and a CDR3 region of SEQ ID NO: 219, and b) a heavy-chain variable region comprising a CDR1 region of SEQ ID NO: 220, a CDR2 region of SEQ ID NO: 221, and a CDR3 region of SEQ ID NO: 222;
38) a binding molecule comprising a) a light-chain variable region comprising a CDR1 region of SEQ ID NO: 223, a CDR2 region of SEQ ID NO: 224, and a CDR3 region of SEQ ID NO: 225, and b) a heavy-chain variable region comprising a CDR1 region of SEQ ID NO: 226, a CDR2 region of SEQ ID NO: 227, and a CDR3 region of SEQ ID NO: 228;
39) a binding molecule comprising a) a light-chain variable region comprising a CDR1 region of SEQ ID NO: 229, a CDR2 region of SEQ ID NO: 230, and a CDR3 region of SEQ ID NO: 231, and b) a heavy-chain variable region comprising a CDR1 region of SEQ ID NO: 232, a CDR2 region of SEQ ID NO: 233, and a CDR3 region of SEQ ID NO: 234;

40) a binding molecule comprising a) a light-chain variable region comprising a CDR1 region of SEQ ID NO: 235, a CDR2 region of SEQ ID NO: 236, and a CDR3 region of SEQ ID NO: 237, and b) a heavy-chain variable region comprising a CDR1 region of SEQ ID NO: 238, a CDR2 region of SEQ ID NO: 239, and a CDR3 region of SEQ ID NO: 240;

41) a binding molecule comprising a) a light-chain variable region comprising a CDR1 region of SEQ ID NO: 241, a CDR2 region of SEQ ID NO: 242, and a CDR3 region of SEQ ID NO: 243, and b) a heavy-chain variable region comprising a CDR1 region of SEQ ID NO: 244, a CDR2 region of SEQ ID NO: 245, and a CDR3 region of SEQ ID NO: 246;

42) a binding molecule comprising a) a light-chain variable region comprising a CDR1 region of SEQ ID NO: 247, a CDR2 region of SEQ ID NO: 248, and a CDR3 region of SEQ ID NO: 249, and b) a heavy-chain variable region comprising a CDR1 region of SEQ ID NO: 250, a CDR2 region of SEQ ID NO: 251, and a CDR3 region of SEQ ID NO: 252;

43) a binding molecule comprising a) a light-chain variable region comprising a CDR1 region of SEQ ID NO: 253, a CDR2 region of SEQ ID NO: 254, and a CDR3 region of SEQ ID NO: 255, and b) a heavy-chain variable region comprising a CDR1 region of SEQ ID NO: 256, a CDR2 region of SEQ ID NO: 257, and a CDR3 region of SEQ ID NO: 258;

44) a binding molecule comprising a) a light-chain variable region comprising a CDR1 region of SEQ ID NO: 259, a CDR2 region of SEQ ID NO: 260, and a CDR3 region of SEQ ID NO: 261, and b) a heavy-chain variable region comprising a CDR1 region of SEQ ID NO: 262, a CDR2 region of SEQ ID NO: 263, and a CDR3 region of SEQ ID NO: 264;

45) a binding molecule comprising a) a light-chain variable region comprising a CDR1 region of SEQ ID NO: 265, a CDR2 region of SEQ ID NO: 266, and a CDR3 region of SEQ ID NO: 267, and b) a heavy-chain variable region comprising a CDR1 region of SEQ ID NO: 268, a CDR2 region of SEQ ID NO: 269, and a CDR3 region of SEQ ID NO: 270;

46) a binding molecule comprising a) a light-chain variable region comprising a CDR1 region of SEQ ID NO: 271, a CDR2 region of SEQ ID NO: 272, and a CDR3 region of SEQ ID NO: 273, and b) a heavy-chain variable region comprising a CDR1 region of SEQ ID NO: 274, a CDR2 region of SEQ ID NO: 275, and a CDR3 region of SEQ ID NO: 276;

47) a binding molecule comprising a) a light-chain variable region comprising a CDR1 region of SEQ ID NO: 277, a CDR2 region of SEQ ID NO: 278, and a CDR3 region of SEQ ID NO: 279, and b) a heavy-chain variable region comprising a CDR1 region of SEQ ID NO: 280, a CDR2 region of SEQ ID NO: 281, and a CDR3 region of SEQ ID NO: 282;

48) a binding molecule comprising a) a light-chain variable region comprising a CDR1 region of SEQ ID NO: 283, a CDR2 region of SEQ ID NO: 284, and a CDR3 region of SEQ ID NO: 285, and b) a heavy-chain variable region comprising a CDR1 region of SEQ ID NO: 286, a CDR2 region of SEQ ID NO: 287, and a CDR3 region of SEQ ID NO: 288;

49) a binding molecule comprising a) a light-chain variable region comprising a CDR1 region of SEQ ID NO: 289, a CDR2 region of SEQ ID NO: 290, and a CDR3 region of SEQ ID NO: 291, and b) a heavy-chain variable region comprising a CDR1 region of SEQ ID NO: 292, a CDR2 region of SEQ ID NO: 293, and a CDR3 region of SEQ ID NO: 294;

50) a binding molecule comprising a) a light-chain variable region comprising a CDR1 region of SEQ ID NO: 295, a CDR2 region of SEQ ID NO: 296, and a CDR3 region of SEQ ID NO: 297, and b) a heavy-chain variable region comprising a CDR1 region of SEQ ID NO: 298, a CDR2 region of SEQ ID NO: 299, and a CDR3 region of SEQ ID NO: 300;

51) a binding molecule comprising a) a light-chain variable region comprising a CDR1 region of SEQ ID NO: 301, a CDR2 region of SEQ ID NO: 302, and a CDR3 region of SEQ ID NO: 303, and b) a heavy-chain variable region comprising a CDR1 region of SEQ ID NO: 304, a CDR2 region of SEQ ID NO: 305, and a CDR3 region of SEQ ID NO: 306;

52) a binding molecule comprising a) a light-chain variable region comprising a CDR1 region of SEQ ID NO: 307, a CDR2 region of SEQ ID NO: 308, and a CDR3 region of SEQ ID NO: 309, and b) a heavy-chain variable region comprising a CDR1 region of SEQ ID NO: 310, a CDR2 region of SEQ ID NO: 311, and a CDR3 region of SEQ ID NO: 312;

53) a binding molecule comprising a) a light-chain variable region comprising a CDR1 region of SEQ ID NO: 313, a CDR2 region of SEQ ID NO: 314, and a CDR3 region of SEQ ID NO: 315, and b) a heavy-chain variable region comprising a CDR1 region of SEQ ID NO: 316, a CDR2 region of SEQ ID NO: 317, and a CDR3 region of SEQ ID NO: 318;

54) a binding molecule comprising a) a light-chain variable region comprising a CDR1 region of SEQ ID NO: 319, a CDR2 region of SEQ ID NO: 320, and a CDR3 region of SEQ ID NO: 321, and b) a heavy-chain variable region comprising a CDR1 region of SEQ ID NO: 322, a CDR2 region of SEQ ID NO: 323, and a CDR3 region of SEQ ID NO: 324;

55) a binding molecule comprising a) a light-chain variable region comprising a CDR1 region of SEQ ID NO: 325, a CDR2 region of SEQ ID NO: 326, and a CDR3 region of SEQ ID NO: 327, and b) a heavy-chain variable region comprising a CDR1 region of SEQ ID NO: 328, a CDR2 region of SEQ ID NO: 329, and a CDR3 region of SEQ ID NO: 330;

56) a binding molecule comprising a) a light-chain variable region comprising a CDR1 region of SEQ ID NO: 331, a CDR2 region of SEQ ID NO: 332, and a CDR3 region of SEQ ID NO: 333, and b) a heavy-chain variable region comprising a CDR1 region of SEQ ID NO: 334, a CDR2 region of SEQ ID NO: 335, and a CDR3 region of SEQ ID NO: 336;

57) a binding molecule comprising a) a light-chain variable region comprising a CDR1 region of SEQ ID NO: 337, a CDR2 region of SEQ ID NO: 338, and a CDR3 region of SEQ ID NO: 339, and b) a heavy-chain variable region comprising a CDR1 region of SEQ ID NO: 340, a CDR2 region of SEQ ID NO: 341, and a CDR3 region of SEQ ID NO: 342;

58) a binding molecule comprising a) a light-chain variable region comprising a CDR1 region of SEQ ID NO: 343, a CDR2 region of SEQ ID NO: 344, and a CDR3 region of SEQ ID NO: 345, and b) a heavy-chain variable region comprising a CDR1 region of SEQ ID NO: 346, a CDR2 region of SEQ ID NO: 347, and a CDR3 region of SEQ ID NO: 348;
59) a binding molecule comprising a) a light-chain variable region comprising a CDR1 region of SEQ ID NO: 349, a CDR2 region of SEQ ID NO: 350, and a CDR3 region of SEQ ID NO: 351, and b) a heavy-chain variable region comprising a CDR1 region of SEQ ID NO: 352, a CDR2 region of SEQ ID NO: 353, and a CDR3 region of SEQ ID NO: 354;
60) a binding molecule comprising a) a light-chain variable region comprising a CDR1 region of SEQ ID NO: 355, a CDR2 region of SEQ ID NO: 356, and a CDR3 region of SEQ ID NO: 357, and b) a heavy-chain variable region comprising a CDR1 region of SEQ ID NO: 358, a CDR2 region of SEQ ID NO: 359, and a CDR3 region of SEQ ID NO: 360;
61) a binding molecule comprising a) a light-chain variable region comprising a CDR1 region of SEQ ID NO: 361, a CDR2 region of SEQ ID NO: 362, and a CDR3 region of SEQ ID NO: 363, and b) a heavy-chain variable region comprising a CDR1 region of SEQ ID NO: 364, a CDR2 region of SEQ ID NO: 365, and a CDR3 region of SEQ ID NO: 366;
62) a binding molecule comprising a) a light-chain variable region comprising a CDR1 region of SEQ ID NO: 367, a CDR2 region of SEQ ID NO: 368, and a CDR3 region of SEQ ID NO: 369, and b) a heavy-chain variable region comprising a CDR1 region of SEQ ID NO: 370, a CDR2 region of SEQ ID NO: 371, and a CDR3 region of SEQ ID NO: 372;
63) a binding molecule comprising a) a light-chain variable region comprising a CDR1 region of SEQ ID NO: 373, a CDR2 region of SEQ ID NO: 374, and a CDR3 region of SEQ ID NO: 375, and b) a heavy-chain variable region comprising a CDR1 region of SEQ ID NO: 376, a CDR2 region of SEQ ID NO: 377, and a CDR3 region of SEQ ID NO: 378;
64) a binding molecule comprising a) a light-chain variable region comprising a CDR1 region of SEQ ID NO: 379, a CDR2 region of SEQ ID NO: 380, and a CDR3 region of SEQ ID NO: 381, and b) a heavy-chain variable region comprising a CDR1 region of SEQ ID NO: 382, a CDR2 region of SEQ ID NO: 383, and a CDR3 region of SEQ ID NO: 384;
65) a binding molecule comprising a) a light-chain variable region comprising a CDR1 region of SEQ ID NO: 385, a CDR2 region of SEQ ID NO: 386, and a CDR3 region of SEQ ID NO: 387, and b) a heavy-chain variable region comprising a CDR1 region of SEQ ID NO: 388, a CDR2 region of SEQ ID NO: 389, and a CDR3 region of SEQ ID NO: 390;
66) a binding molecule comprising a) a light-chain variable region comprising a CDR1 region of SEQ ID NO: 391, a CDR2 region of SEQ ID NO: 392, and a CDR3 region of SEQ ID NO: 393, and b) a heavy-chain variable region comprising a CDR1 region of SEQ ID NO: 394, a CDR2 region of SEQ ID NO: 395, and a CDR3 region of SEQ ID NO: 396;
67) a binding molecule comprising a) a light-chain variable region comprising a CDR1 region of SEQ ID NO: 397, a CDR2 region of SEQ ID NO: 398, and a CDR3 region of SEQ ID NO: 399, and b) a heavy-chain variable region comprising a CDR1 region of SEQ ID NO: 400, a CDR2 region of SEQ ID NO: 401, and a CDR3 region of SEQ ID NO: 402;
68) a binding molecule comprising a) a light-chain variable region comprising a CDR1 region of SEQ ID NO: 403, a CDR2 region of SEQ ID NO: 404, and a CDR3 region of SEQ ID NO: 405, and b) a heavy-chain variable region comprising a CDR1 region of SEQ ID NO: 406, a CDR2 region of SEQ ID NO: 407, and a CDR3 region of SEQ ID NO: 408;
69) a binding molecule comprising a) a light-chain variable region comprising a CDR1 region of SEQ ID NO: 409, a CDR2 region of SEQ ID NO: 410, and a CDR3 region of SEQ ID NO: 411, and b) a heavy-chain variable region comprising a CDR1 region of SEQ ID NO: 412, a CDR2 region of SEQ ID NO: 413, and a CDR3 region of SEQ ID NO: 414;
70) a binding molecule comprising a) a light-chain variable region comprising a CDR1 region of SEQ ID NO: 415, a CDR2 region of SEQ ID NO: 416, and a CDR3 region of SEQ ID NO: 417, and b) a heavy-chain variable region comprising a CDR1 region of SEQ ID NO: 418, a CDR2 region of SEQ ID NO: 419, and a CDR3 region of SEQ ID NO: 420;
71) a binding molecule comprising a) a light-chain variable region comprising a CDR1 region of SEQ ID NO: 421, a CDR2 region of SEQ ID NO: 422, and a CDR3 region of SEQ ID NO: 423, and b) a heavy-chain variable region comprising a CDR1 region of SEQ ID NO: 424, a CDR2 region of SEQ ID NO: 425, and a CDR3 region of SEQ ID NO: 426;
72) a binding molecule comprising a) a light-chain variable region comprising a CDR1 region of SEQ ID NO: 427, a CDR2 region of SEQ ID NO: 428, and a CDR3 region of SEQ ID NO: 429, and b) a heavy-chain variable region comprising a CDR1 region of SEQ ID NO: 430, a CDR2 region of SEQ ID NO: 431, and a CDR3 region of SEQ ID NO: 432;
73) a binding molecule comprising a) a light-chain variable region comprising a CDR1 region of SEQ ID NO: 433, a CDR2 region of SEQ ID NO: 434, and a CDR3 region of SEQ ID NO: 435, and b) a heavy-chain variable region comprising a CDR1 region of SEQ ID NO: 436, a CDR2 region of SEQ ID NO: 437, and a CDR3 region of SEQ ID NO: 438;
74) a binding molecule comprising a) a light-chain variable region comprising a CDR1 region of SEQ ID NO: 439, a CDR2 region of SEQ ID NO: 440, and a CDR3 region of SEQ ID NO: 441, and b) a heavy-chain variable region comprising a CDR1 region of SEQ ID NO: 442, a CDR2 region of SEQ ID NO: 443, and a CDR3 region of SEQ ID NO: 444;
75) a binding molecule comprising a) a light-chain variable region comprising a CDR1 region of SEQ ID NO: 445, a CDR2 region of SEQ ID NO: 446, and a CDR3 region of SEQ ID NO: 447, and b) a heavy-chain variable region comprising a CDR1 region of SEQ ID NO: 448, a CDR2 region of SEQ ID NO: 449, and a CDR3 region of SEQ ID NO: 450;
76) a binding molecule comprising a) a light-chain variable region comprising a CDR1 region of SEQ ID NO: 451, a CDR2 region of SEQ ID NO: 452, and a CDR3 region of SEQ ID NO: 453, and b) a heavy-chain variable region comprising a CDR1 region of SEQ ID NO: 454, a CDR2 region of SEQ ID NO: 455, and a CDR3 region of SEQ ID NO: 456;
77) a binding molecule comprising a) a light-chain variable region comprising a CDR1 region of SEQ ID NO: 457, a CDR2 region of SEQ ID NO: 458, and a CDR3 region of SEQ ID NO: 459, and b) a heavy-chain variable region comprising a CDR1 region of SEQ ID NO: 460, a CDR2 region of SEQ ID NO: 461, and a CDR3 region of SEQ ID NO: 462;

78) a binding molecule comprising a) a light-chain variable region comprising a CDR1 region of SEQ ID NO: 463, a CDR2 region of SEQ ID NO: 464, and a CDR3 region of SEQ ID NO: 465, and b) a heavy-chain variable region comprising a CDR1 region of SEQ ID NO: 466, a CDR2 region of SEQ ID NO: 467, and a CDR3 region of SEQ ID NO: 468;

79) a binding molecule comprising a) a light-chain variable region comprising a CDR1 region of SEQ ID NO: 469, a CDR2 region of SEQ ID NO: 470, and a CDR3 region of SEQ ID NO: 471, and b) a heavy-chain variable region comprising a CDR1 region of SEQ ID NO: 472, a CDR2 region of SEQ ID NO: 473, and a CDR3 region of SEQ ID NO: 474;

80) a binding molecule comprising a) a light-chain variable region comprising a CDR1 region of SEQ ID NO: 475, a CDR2 region of SEQ ID NO: 476, and a CDR3 region of SEQ ID NO: 477, and b) a heavy-chain variable region comprising a CDR1 region of SEQ ID NO: 478, a CDR2 region of SEQ ID NO: 479, and a CDR3 region of SEQ ID NO: 480;

81) a binding molecule comprising a) a light-chain variable region comprising a CDR1 region of SEQ ID NO: 481, a CDR2 region of SEQ ID NO: 482, and a CDR3 region of SEQ ID NO: 483, and b) a heavy-chain variable region comprising a CDR1 region of SEQ ID NO: 484, a CDR2 region of SEQ ID NO: 485, and a CDR3 region of SEQ ID NO: 486;

82) a binding molecule comprising a) a light-chain variable region comprising a CDR1 region of SEQ ID NO: 487, a CDR2 region of SEQ ID NO: 488, and a CDR3 region of SEQ ID NO: 489, and b) a heavy-chain variable region comprising a CDR1 region of SEQ ID NO: 490, a CDR2 region of SEQ ID NO: 491, and a CDR3 region of SEQ ID NO: 492;

83) a binding molecule comprising a) a light-chain variable region comprising a CDR1 region of SEQ ID NO: 493, a CDR2 region of SEQ ID NO: 494, and a CDR3 region of SEQ ID NO: 495, and b) a heavy-chain variable region comprising a CDR1 region of SEQ ID NO: 496, a CDR2 region of SEQ ID NO: 497, and a CDR3 region of SEQ ID NO: 498;

84) a binding molecule comprising a) a light-chain variable region comprising a CDR1 region of SEQ ID NO: 499, a CDR2 region of SEQ ID NO: 500, and a CDR3 region of SEQ ID NO: 501, and b) a heavy-chain variable region comprising a CDR1 region of SEQ ID NO: 502, a CDR2 region of SEQ ID NO: 503, and a CDR3 region of SEQ ID NO: 504;

85) a binding molecule comprising a) a light-chain variable region comprising a CDR1 region of SEQ ID NO: 505, a CDR2 region of SEQ ID NO: 506, and a CDR3 region of SEQ ID NO: 507, and b) a heavy-chain variable region comprising a CDR1 region of SEQ ID NO: 508, a CDR2 region of SEQ ID NO: 509, and a CDR3 region of SEQ ID NO: 510;

86) a binding molecule comprising a) a light-chain variable region comprising a CDR1 region of SEQ ID NO: 511, a CDR2 region of SEQ ID NO: 512, and a CDR3 region of SEQ ID NO: 513, and b) a heavy-chain variable region comprising a CDR1 region of SEQ ID NO: 514, a CDR2 region of SEQ ID NO: 515, and a CDR3 region of SEQ ID NO: 516;

87) a binding molecule comprising a) a light-chain variable region comprising a CDR1 region of SEQ ID NO: 517, a CDR2 region of SEQ ID NO: 518, and a CDR3 region of SEQ ID NO: 519, and b) a heavy-chain variable region comprising a CDR1 region of SEQ ID NO: 520, a CDR2 region of SEQ ID NO: 521, and a CDR3 region of SEQ ID NO: 522;

88) a binding molecule comprising a) a light-chain variable region comprising a CDR1 region of SEQ ID NO: 523, a CDR2 region of SEQ ID NO: 524, and a CDR3 region of SEQ ID NO: 525, and b) a heavy-chain variable region comprising a CDR1 region of SEQ ID NO: 526, a CDR2 region of SEQ ID NO: 527, and a CDR3 region of SEQ ID NO: 528;

89) a binding molecule comprising a) a light-chain variable region comprising a CDR1 region of SEQ ID NO: 529, a CDR2 region of SEQ ID NO: 530, and a CDR3 region of SEQ ID NO: 531, and b) a heavy-chain variable region comprising a CDR1 region of SEQ ID NO: 532, a CDR2 region of SEQ ID NO: 533, and a CDR3 region of SEQ ID NO: 534;

90) a binding molecule comprising a) a light-chain variable region comprising a CDR1 region of SEQ ID NO: 535, a CDR2 region of SEQ ID NO: 536, and a CDR3 region of SEQ ID NO: 537, and b) a heavy-chain variable region comprising a CDR1 region of SEQ ID NO: 538, a CDR2 region of SEQ ID NO: 539, and a CDR3 region of SEQ ID NO: 540;

91) a binding molecule comprising a) a light-chain variable region comprising a CDR1 region of SEQ ID NO: 541, a CDR2 region of SEQ ID NO: 542, and a CDR3 region of SEQ ID NO: 543, and b) a heavy-chain variable region comprising a CDR1 region of SEQ ID NO: 544, a CDR2 region of SEQ ID NO: 545, and a CDR3 region of SEQ ID NO: 546;

92) a binding molecule comprising a) a light-chain variable region comprising a CDR1 region of SEQ ID NO: 547, a CDR2 region of SEQ ID NO: 548, and a CDR3 region of SEQ ID NO: 549, and b) a heavy-chain variable region comprising a CDR1 region of SEQ ID NO: 550, a CDR2 region of SEQ ID NO: 551, and a CDR3 region of SEQ ID NO: 552;

93) a binding molecule comprising a) a light-chain variable region comprising a CDR1 region of SEQ ID NO: 553, a CDR2 region of SEQ ID NO: 554, and a CDR3 region of SEQ ID NO: 555, and b) a heavy-chain variable region comprising a CDR1 region of SEQ ID NO: 556, a CDR2 region of SEQ ID NO: 557, and a CDR3 region of SEQ ID NO: 558;

94) a binding molecule comprising a) a light-chain variable region comprising a CDR1 region of SEQ ID NO: 559, a CDR2 region of SEQ ID NO: 560, and a CDR3 region of SEQ ID NO: 561, and b) a heavy-chain variable region comprising a CDR1 region of SEQ ID NO: 562, a CDR2 region of SEQ ID NO: 563, and a CDR3 region of SEQ ID NO: 564;

95) a binding molecule comprising a) a light-chain variable region comprising a CDR1 region of SEQ ID NO: 565, a CDR2 region of SEQ ID NO: 566, and a CDR3 region of SEQ ID NO: 567, and b) a heavy-chain variable region comprising a CDR1 region of SEQ ID NO: 568, a CDR2 region of SEQ ID NO: 569, and a CDR3 region of SEQ ID NO: 570;

96) a binding molecule comprising a) a light-chain variable region comprising a CDR1 region of SEQ ID NO: 571, a CDR2 region of SEQ ID NO: 572, and a CDR3 region of SEQ ID NO: 573, and b) a heavy-chain variable region comprising a CDR1 region of SEQ ID NO: 574, a CDR2 region of SEQ ID NO: 575, and a CDR3 region of SEQ ID NO: 576;

97) a binding molecule comprising a) a light-chain variable region comprising a CDR1 region of SEQ ID NO: 577, a CDR2 region of SEQ ID NO: 578, and a CDR3 region of SEQ ID NO: 579, and b) a heavy-chain variable region comprising a CDR1 region of SEQ ID NO: 580, a CDR2 region of SEQ ID NO: 581, and a CDR3 region of SEQ ID NO: 582;

98) a binding molecule comprising a) a light-chain variable region comprising a CDR1 region of SEQ ID NO: 583, a CDR2 region of SEQ ID NO: 584, and a CDR3 region of SEQ ID NO: 585, and b) a heavy-chain variable region comprising a CDR1 region of SEQ ID NO: 586, a CDR2 region of SEQ ID NO: 587, and a CDR3 region of SEQ ID NO: 588;

99) a binding molecule comprising a) a light-chain variable region comprising a CDR1 region of SEQ ID NO: 589, a CDR2 region of SEQ ID NO: 590, and a CDR3 region of SEQ ID NO: 591, and b) a heavy-chain variable region comprising a CDR1 region of SEQ ID NO: 592, a CDR2 region of SEQ ID NO: 593, and a CDR3 region of SEQ ID NO: 594;

100) a binding molecule comprising a) a light-chain variable region comprising a CDR1 region of SEQ ID NO: 595, a CDR2 region of SEQ ID NO: 596, and a CDR3 region of SEQ ID NO: 597, and b) a heavy-chain variable region comprising a CDR1 region of SEQ ID NO: 598, a CDR2 region of SEQ ID NO: 599, and a CDR3 region of SEQ ID NO: 600;

101) a binding molecule comprising a) a light-chain variable region comprising a CDR1 region of SEQ ID NO: 601, a CDR2 region of SEQ ID NO: 602, and a CDR3 region of SEQ ID NO: 603, and b) a heavy-chain variable region comprising a CDR1 region of SEQ ID NO: 604, a CDR2 region of SEQ ID NO: 605, and a CDR3 region of SEQ ID NO: 606;

102) a binding molecule comprising a) a light-chain variable region comprising a CDR1 region of SEQ ID NO: 607, a CDR2 region of SEQ ID NO: 608, and a CDR3 region of SEQ ID NO: 609, and b) a heavy-chain variable region comprising a CDR1 region of SEQ ID NO: 610, a CDR2 region of SEQ ID NO: 611, and a CDR3 region of SEQ ID NO: 612;

103) a binding molecule comprising a) a light-chain variable region comprising a CDR1 region of SEQ ID NO: 613, a CDR2 region of SEQ ID NO: 614, and a CDR3 region of SEQ ID NO: 615, and b) a heavy-chain variable region comprising a CDR1 region of SEQ ID NO: 616, a CDR2 region of SEQ ID NO: 617, and a CDR3 region of SEQ ID NO: 618;

104) a binding molecule comprising a) a light-chain variable region comprising a CDR1 region of SEQ ID NO: 619, a CDR2 region of SEQ ID NO: 620, and a CDR3 region of SEQ ID NO: 621, and b) a heavy-chain variable region comprising a CDR1 region of SEQ ID NO: 622, a CDR2 region of SEQ ID NO: 623, and a CDR3 region of SEQ ID NO: 624;

105) a binding molecule comprising a) a light-chain variable region comprising a CDR1 region of SEQ ID NO: 625, a CDR2 region of SEQ ID NO: 626, and a CDR3 region of SEQ ID NO: 627, and b) a heavy-chain variable region comprising a CDR1 region of SEQ ID NO: 628, a CDR2 region of SEQ ID NO: 629, and a CDR3 region of SEQ ID NO: 630;

106) a binding molecule comprising a) a light-chain variable region comprising a CDR1 region of SEQ ID NO: 631, a CDR2 region of SEQ ID NO: 632, and a CDR3 region of SEQ ID NO: 633, and b) a heavy-chain variable region comprising a CDR1 region of SEQ ID NO: 634, a CDR2 region of SEQ ID NO: 635, and a CDR3 region of SEQ ID NO: 636;

107) a binding molecule comprising a) a light-chain variable region comprising a CDR1 region of SEQ ID NO: 637, a CDR2 region of SEQ ID NO: 638, and a CDR3 region of SEQ ID NO: 639, and b) a heavy-chain variable region comprising a CDR1 region of SEQ ID NO: 640, a CDR2 region of SEQ ID NO: 641, and a CDR3 region of SEQ ID NO: 642;

108) a binding molecule comprising a) a light-chain variable region comprising a CDR1 region of SEQ ID NO: 643, a CDR2 region of SEQ ID NO: 644, and a CDR3 region of SEQ ID NO: 645, and b) a heavy-chain variable region comprising a CDR1 region of SEQ ID NO: 646, a CDR2 region of SEQ ID NO: 647, and a CDR3 region of SEQ ID NO: 648;

109) a binding molecule comprising a) a light-chain variable region comprising a CDR1 region of SEQ ID NO: 649, a CDR2 region of SEQ ID NO: 650, and a CDR3 region of SEQ ID NO: 651, and b) a heavy-chain variable region comprising a CDR1 region of SEQ ID NO: 652, a CDR2 region of SEQ ID NO: 653, and a CDR3 region of SEQ ID NO: 654;

110) a binding molecule comprising a) a light-chain variable region comprising a CDR1 region of SEQ ID NO: 655, a CDR2 region of SEQ ID NO: 656, and a CDR3 region of SEQ ID NO: 657, and b) a heavy-chain variable region comprising a CDR1 region of SEQ ID NO: 658, a CDR2 region of SEQ ID NO: 659, and a CDR3 region of SEQ ID NO: 660;

111) a binding molecule comprising a) a light-chain variable region comprising a CDR1 region of SEQ ID NO: 661, a CDR2 region of SEQ ID NO: 662, and a CDR3 region of SEQ ID NO: 663, and b) a heavy-chain variable region comprising a CDR1 region of SEQ ID NO: 664, a CDR2 region of SEQ ID NO: 665, and a CDR3 region of SEQ ID NO: 666;

112) a binding molecule comprising a) a light-chain variable region comprising a CDR1 region of SEQ ID NO: 667, a CDR2 region of SEQ ID NO: 668, and a CDR3 region of SEQ ID NO: 669, and b) a heavy-chain variable region comprising a CDR1 region of SEQ ID NO: 670, a CDR2 region of SEQ ID NO: 671, and a CDR3 region of SEQ ID NO: 672;

113) a binding molecule comprising a) a light-chain variable region comprising a CDR1 region of SEQ ID NO: 673, a CDR2 region of SEQ ID NO: 674, and a CDR3 region of SEQ ID NO: 675, and b) a heavy-chain variable region comprising a CDR1 region of SEQ ID NO: 676, a CDR2 region of SEQ ID NO: 677, and a CDR3 region of SEQ ID NO: 678;

114) a binding molecule comprising a) a light-chain variable region comprising a CDR1 region of SEQ ID NO: 679, a CDR2 region of SEQ ID NO: 680, and a CDR3 region of SEQ ID NO: 681, and b) a heavy-chain variable region comprising a CDR1 region of SEQ ID NO: 682, a CDR2 region of SEQ ID NO: 683, and a CDR3 region of SEQ ID NO: 684;

115) a binding molecule comprising a) a light-chain variable region comprising a CDR1 region of SEQ ID NO: 685, a CDR2 region of SEQ ID NO: 686, and a CDR3 region of SEQ ID NO: 687, and b) a heavy-chain variable region comprising a CDR1 region of SEQ ID NO: 688, a CDR2 region of SEQ ID NO: 689, and a CDR3 region of SEQ ID NO: 690;
116) a binding molecule comprising a) a light-chain variable region comprising a CDR1 region of SEQ ID NO: 691, a CDR2 region of SEQ ID NO: 692, and a CDR3 region of SEQ ID NO: 693, and b) a heavy-chain variable region comprising a CDR1 region of SEQ ID NO: 694, a CDR2 region of SEQ ID NO: 695, and a CDR3 region of SEQ ID NO: 696;
117) a binding molecule comprising a) a light-chain variable region comprising a CDR1 region of SEQ ID NO: 697, a CDR2 region of SEQ ID NO: 698, and a CDR3 region of SEQ ID NO: 699, and b) a heavy-chain variable region comprising a CDR1 region of SEQ ID NO: 700, a CDR2 region of SEQ ID NO: 701, and a CDR3 region of SEQ ID NO: 702;
118) a binding molecule comprising a) a light-chain variable region comprising a CDR1 region of SEQ ID NO: 703, a CDR2 region of SEQ ID NO: 704, and a CDR3 region of SEQ ID NO: 705, and b) a heavy-chain variable region comprising a CDR1 region of SEQ ID NO: 706, a CDR2 region of SEQ ID NO: 707, and a CDR3 region of SEQ ID NO: 708;
119) a binding molecule comprising a) a light-chain variable region comprising a CDR1 region of SEQ ID NO: 709, a CDR2 region of SEQ ID NO: 710, and a CDR3 region of SEQ ID NO: 711, and b) a heavy-chain variable region comprising a CDR1 region of SEQ ID NO: 712, a CDR2 region of SEQ ID NO: 713, and a CDR3 region of SEQ ID NO: 714;
120) a binding molecule comprising a) a light-chain variable region comprising a CDR1 region of SEQ ID NO: 715, a CDR2 region of SEQ ID NO: 716, and a CDR3 region of SEQ ID NO: 717, and b) a heavy-chain variable region comprising a CDR1 region of SEQ ID NO: 718, a CDR2 region of SEQ ID NO: 719, and a CDR3 region of SEQ ID NO: 720;
121) a binding molecule comprising a) a light-chain variable region comprising a CDR1 region of SEQ ID NO: 721, a CDR2 region of SEQ ID NO: 722, and a CDR3 region of SEQ ID NO: 723, and b) a heavy-chain variable region comprising a CDR1 region of SEQ ID NO: 724, a CDR2 region of SEQ ID NO: 725, and a CDR3 region of SEQ ID NO: 726;
122) a binding molecule comprising a) a light-chain variable region comprising a CDR1 region of SEQ ID NO: 727, a CDR2 region of SEQ ID NO: 728, and a CDR3 region of SEQ ID NO: 729, and b) a heavy-chain variable region comprising a CDR1 region of SEQ ID NO: 730, a CDR2 region of SEQ ID NO: 731, and a CDR3 region of SEQ ID NO: 732;
123) a binding molecule comprising a) a light-chain variable region comprising a CDR1 region of SEQ ID NO: 733, a CDR2 region of SEQ ID NO: 734, and a CDR3 region of SEQ ID NO: 735, and b) a heavy-chain variable region comprising a CDR1 region of SEQ ID NO: 736, a CDR2 region of SEQ ID NO: 737, and a CDR3 region of SEQ ID NO: 738;
124) a binding molecule comprising a) a light-chain variable region comprising a CDR1 region of SEQ ID NO: 739, a CDR2 region of SEQ ID NO: 740, and a CDR3 region of SEQ ID NO: 741, and b) a heavy-chain variable region comprising a CDR1 region of SEQ ID NO: 742, a CDR2 region of SEQ ID NO: 743, and a CDR3 region of SEQ ID NO: 744;
125) a binding molecule comprising a) a light-chain variable region comprising a CDR1 region of SEQ ID NO: 745, a CDR2 region of SEQ ID NO: 746, and a CDR3 region of SEQ ID NO: 747, and b) a heavy-chain variable region comprising a CDR1 region of SEQ ID NO: 748, a CDR2 region of SEQ ID NO: 749, and a CDR3 region of SEQ ID NO: 750;
126) a binding molecule comprising a) a light-chain variable region comprising a CDR1 region of SEQ ID NO: 751, a CDR2 region of SEQ ID NO: 752, and a CDR3 region of SEQ ID NO: 753, and b) a heavy-chain variable region comprising a CDR1 region of SEQ ID NO: 754, a CDR2 region of SEQ ID NO: 755, and a CDR3 region of SEQ ID NO: 756;
127) a binding molecule comprising a) a light-chain variable region comprising a CDR1 region of SEQ ID NO: 757, a CDR2 region of SEQ ID NO: 758, and a CDR3 region of SEQ ID NO: 759, and b) a heavy-chain variable region comprising a CDR1 region of SEQ ID NO: 760, a CDR2 region of SEQ ID NO: 761, and a CDR3 region of SEQ ID NO: 762;
128) a binding molecule comprising a) a light-chain variable region comprising a CDR1 region of SEQ ID NO: 763, a CDR2 region of SEQ ID NO: 764, and a CDR3 region of SEQ ID NO: 765, and b) a heavy-chain variable region comprising a CDR1 region of SEQ ID NO: 766, a CDR2 region of SEQ ID NO: 767, and a CDR3 region of SEQ ID NO: 768;
129) a binding molecule comprising a) a light-chain variable region comprising a CDR1 region of SEQ ID NO: 769, a CDR2 region of SEQ ID NO: 770, and a CDR3 region of SEQ ID NO: 771, and b) a heavy-chain variable region comprising a CDR1 region of SEQ ID NO: 772, a CDR2 region of SEQ ID NO: 773, and a CDR3 region of SEQ ID NO: 774;
130) a binding molecule comprising a) a light-chain variable region comprising a CDR1 region of SEQ ID NO: 775, a CDR2 region of SEQ ID NO: 776, and a CDR3 region of SEQ ID NO: 777, and b) a heavy-chain variable region comprising a CDR1 region of SEQ ID NO: 778, a CDR2 region of SEQ ID NO: 779, and a CDR3 region of SEQ ID NO: 780;
131) a binding molecule comprising a) a light-chain variable region comprising a CDR1 region of SEQ ID NO: 781, a CDR2 region of SEQ ID NO: 782, and a CDR3 region of SEQ ID NO: 783, and b) a heavy-chain variable region comprising a CDR1 region of SEQ ID NO: 784, a CDR2 region of SEQ ID NO: 785, and a CDR3 region of SEQ ID NO: 786;
132) a binding molecule comprising a) a light-chain variable region comprising a CDR1 region of SEQ ID NO: 787, a CDR2 region of SEQ ID NO: 788, and a CDR3 region of SEQ ID NO: 789, and b) a heavy-chain variable region comprising a CDR1 region of SEQ ID NO: 790, a CDR2 region of SEQ ID NO: 791, and a CDR3 region of SEQ ID NO: 792;
133) a binding molecule comprising a) a light-chain variable region comprising a CDR1 region of SEQ ID NO: 793, a CDR2 region of SEQ ID NO: 794, and a CDR3 region of SEQ ID NO: 795, and b) a heavy-chain variable region comprising a CDR1 region of SEQ ID NO: 796, a CDR2 region of SEQ ID NO: 797, and a CDR3 region of SEQ ID NO: 798;
134) a binding molecule comprising a) a light-chain variable region comprising a CDR1 region of SEQ ID NO: 799, a CDR2 region of SEQ ID NO: 800, and a CDR3 region of SEQ ID NO: 801, and b) a heavy-chain variable region comprising a CDR1 region of SEQ ID NO: 802, a CDR2 region of SEQ ID NO: 803, and a CDR3 region of SEQ ID NO: 804;
135) a binding molecule comprising a) a light-chain variable region comprising a CDR1 region of SEQ ID NO: 805, a CDR2 region of SEQ ID NO: 806, and a CDR3 region of SEQ ID NO: 807, and b) a heavy-chain variable region comprising a CDR1 region of SEQ ID NO: 808, a CDR2 region of SEQ ID NO: 809, and a CDR3 region of SEQ ID NO: 810;
136) a binding molecule comprising a) a light-chain variable region comprising a CDR1 region of SEQ ID NO: 811, a CDR2 region of SEQ ID NO: 812, and a CDR3 region of SEQ ID NO: 813, and b) a heavy-chain variable region comprising a CDR1 region of SEQ ID NO: 814, a CDR2 region of SEQ ID NO: 815, and a CDR3 region of SEQ ID NO: 816;
137) a binding molecule comprising a) a light-chain variable region comprising a CDR1 region of SEQ ID NO: 817, a CDR2 region of SEQ ID NO: 818, and a CDR3 region of SEQ ID NO: 819, and b) a heavy-chain variable region comprising a CDR1 region of SEQ ID NO: 820, a CDR2 region of SEQ ID NO: 821, and a CDR3 region of SEQ ID NO: 822;
138) a binding molecule comprising a) a light-chain variable region comprising a CDR1 region of SEQ ID NO: 823, a CDR2 region of SEQ ID NO: 824, and a CDR3 region of SEQ ID NO: 825, and b) a heavy-chain variable region comprising a CDR1 region of SEQ ID NO: 826, a CDR2 region of SEQ ID NO: 827, and a CDR3 region of SEQ ID NO: 828;
139) a binding molecule comprising a) a light-chain variable region comprising a CDR1 region of SEQ ID NO: 829, a CDR2 region of SEQ ID NO: 830, and a CDR3 region of SEQ ID NO: 831, and b) a heavy-chain variable region comprising a CDR1 region of SEQ ID NO: 832, a CDR2 region of SEQ ID NO: 833, and a CDR3 region of SEQ ID NO: 834;
140) a binding molecule comprising a) a light-chain variable region comprising a CDR1 region of SEQ ID NO: 835, a CDR2 region of SEQ ID NO: 836, and a CDR3 region of SEQ ID NO: 837, and b) a heavy-chain variable region comprising a CDR1 region of SEQ ID NO: 838, a CDR2 region of SEQ ID NO: 839, and a CDR3 region of SEQ ID NO: 840;
141) a binding molecule comprising a) a light-chain variable region comprising a CDR1 region of SEQ ID NO: 841, a CDR2 region of SEQ ID NO: 842, and a CDR3 region of SEQ ID NO: 843, and b) a heavy-chain variable region comprising a CDR1 region of SEQ ID NO: 844, a CDR2 region of SEQ ID NO: 845, and a CDR3 region of SEQ ID NO: 846;
142) a binding molecule comprising a) a light-chain variable region comprising a CDR1 region of SEQ ID NO: 847, a CDR2 region of SEQ ID NO: 848, and a CDR3 region of SEQ ID NO: 849, and b) a heavy-chain variable region comprising a CDR1 region of SEQ ID NO: 850, a CDR2 region of SEQ ID NO: 851, and a CDR3 region of SEQ ID NO: 852;
143) a binding molecule comprising a) a light-chain variable region comprising a CDR1 region of SEQ ID NO: 853, a CDR2 region of SEQ ID NO: 854, and a CDR3 region of SEQ ID NO: 855, and b) a heavy-chain variable region comprising a CDR1 region of SEQ ID NO: 856, a CDR2 region of SEQ ID NO: 857, and a CDR3 region of SEQ ID NO: 858;
144) a binding molecule comprising a) a light-chain variable region comprising a CDR1 region of SEQ ID NO: 859, a CDR2 region of SEQ ID NO: 860, and a CDR3 region of SEQ ID NO: 861, and b) a heavy-chain variable region comprising a CDR1 region of SEQ ID NO: 862, a CDR2 region of SEQ ID NO: 863, and a CDR3 region of SEQ ID NO: 864;
145) a binding molecule comprising a) a light-chain variable region comprising a CDR1 region of SEQ ID NO: 865, a CDR2 region of SEQ ID NO: 866, and a CDR3 region of SEQ ID NO: 867, and b) a heavy-chain variable region comprising a CDR1 region of SEQ ID NO: 868, a CDR2 region of SEQ ID NO: 869, and a CDR3 region of SEQ ID NO: 870;
146) a binding molecule comprising a) a light-chain variable region comprising a CDR1 region of SEQ ID NO: 871, a CDR2 region of SEQ ID NO: 872, and a CDR3 region of SEQ ID NO: 873, and b) a heavy-chain variable region comprising a CDR1 region of SEQ ID NO: 874, a CDR2 region of SEQ ID NO: 875, and a CDR3 region of SEQ ID NO: 876;
147) a binding molecule comprising a) a light-chain variable region comprising a CDR1 region of SEQ ID NO: 877, a CDR2 region of SEQ ID NO: 878, and a CDR3 region of SEQ ID NO: 879, and b) a heavy-chain variable region comprising a CDR1 region of SEQ ID NO: 880, a CDR2 region of SEQ ID NO: 881, and a CDR3 region of SEQ ID NO: 882;
148) a binding molecule comprising a) a light-chain variable region comprising a CDR1 region of SEQ ID NO: 883, a CDR2 region of SEQ ID NO: 884, and a CDR3 region of SEQ ID NO: 885, and b) a heavy-chain variable region comprising a CDR1 region of SEQ ID NO: 886, a CDR2 region of SEQ ID NO: 887, and a CDR3 region of SEQ ID NO: 888;
149) a binding molecule comprising a) a light-chain variable region comprising a CDR1 region of SEQ ID NO: 889, a CDR2 region of SEQ ID NO: 890, and a CDR3 region of SEQ ID NO: 891, and b) a heavy-chain variable region comprising a CDR1 region of SEQ ID NO: 892, a CDR2 region of SEQ ID NO: 893, and a CDR3 region of SEQ ID NO: 894;
150) a binding molecule comprising a) a light-chain variable region comprising a CDR1 region of SEQ ID NO: 895, a CDR2 region of SEQ ID NO: 896, and a CDR3 region of SEQ ID NO: 897, and b) a heavy-chain variable region comprising a CDR1 region of SEQ ID NO: 898, a CDR2 region of SEQ ID NO: 899, and a CDR3 region of SEQ ID NO: 900;
151) a binding molecule comprising a) a light-chain variable region comprising a CDR1 region of SEQ ID NO: 901, a CDR2 region of SEQ ID NO: 902, and a CDR3 region of SEQ ID NO: 903, and b) a heavy-chain variable region comprising a CDR1 region of SEQ ID NO: 904, a CDR2 region of SEQ ID NO: 905, and a CDR3 region of SEQ ID NO: 906;
152) a binding molecule comprising a) a light-chain variable region comprising a CDR1 region of SEQ ID NO: 907, a CDR2 region of SEQ ID NO: 908, and a CDR3 region of SEQ ID NO: 909, and b) a heavy-chain variable region comprising a CDR1 region of SEQ ID NO: 910, a CDR2 region of SEQ ID NO: 911, and a CDR3 region of SEQ ID NO: 912;
153) a binding molecule comprising a) a light-chain variable region comprising a CDR1 region of SEQ ID NO: 913, a CDR2 region of SEQ ID NO: 914, and a CDR3 region of SEQ ID NO: 915, and b) a heavy-chain variable region comprising a CDR1 region of SEQ ID NO: 916, a CDR2 region of SEQ ID NO: 917, and a CDR3 region of SEQ ID NO: 918;

154) a binding molecule comprising a) a light-chain variable region comprising a CDR1 region of SEQ ID NO: 919, a CDR2 region of SEQ ID NO: 920, and a CDR3 region of SEQ ID NO: 921, and b) a heavy-chain variable region comprising a CDR1 region of SEQ ID NO: 922, a CDR2 region of SEQ ID NO: 923, and a CDR3 region of SEQ ID NO: 924;

155) a binding molecule comprising a) a light-chain variable region comprising a CDR1 region of SEQ ID NO: 925, a CDR2 region of SEQ ID NO: 926, and a CDR3 region of SEQ ID NO: 927, and b) a heavy-chain variable region comprising a CDR1 region of SEQ ID NO: 928, a CDR2 region of SEQ ID NO: 929, and a CDR3 region of SEQ ID NO: 930;

156) a binding molecule comprising a) a light-chain variable region comprising a CDR1 region of SEQ ID NO: 931, a CDR2 region of SEQ ID NO: 932, and a CDR3 region of SEQ ID NO: 933, and b) a heavy-chain variable region comprising a CDR1 region of SEQ ID NO: 934, a CDR2 region of SEQ ID NO: 935, and a CDR3 region of SEQ ID NO: 936;

157) a binding molecule comprising a) a light-chain variable region comprising a CDR1 region of SEQ ID NO: 937, a CDR2 region of SEQ ID NO: 938, and a CDR3 region of SEQ ID NO: 939, and b) a heavy-chain variable region comprising a CDR1 region of SEQ ID NO: 940, a CDR2 region of SEQ ID NO: 941, and a CDR3 region of SEQ ID NO: 942;

158) a binding molecule comprising a) a light-chain variable region comprising a CDR1 region of SEQ ID NO: 943, a CDR2 region of SEQ ID NO: 944, and a CDR3 region of SEQ ID NO: 945, and b) a heavy-chain variable region comprising a CDR1 region of SEQ ID NO: 946, a CDR2 region of SEQ ID NO: 947, and a CDR3 region of SEQ ID NO: 948;

159) a binding molecule comprising a) a light-chain variable region comprising a CDR1 region of SEQ ID NO: 949, a CDR2 region of SEQ ID NO: 950, and a CDR3 region of SEQ ID NO: 951, and b) a heavy-chain variable region comprising a CDR1 region of SEQ ID NO: 952, a CDR2 region of SEQ ID NO: 953, and a CDR3 region of SEQ ID NO: 954;

160) a binding molecule comprising a) a light-chain variable region comprising a CDR1 region of SEQ ID NO: 955, a CDR2 region of SEQ ID NO: 956, and a CDR3 region of SEQ ID NO: 957, and b) a heavy-chain variable region comprising a CDR1 region of SEQ ID NO: 958, a CDR2 region of SEQ ID NO: 959, and a CDR3 region of SEQ ID NO: 960;

161) a binding molecule comprising a) a light-chain variable region comprising a CDR1 region of SEQ ID NO: 961, a CDR2 region of SEQ ID NO: 962, and a CDR3 region of SEQ ID NO: 963, and b) a heavy-chain variable region comprising a CDR1 region of SEQ ID NO: 964, a CDR2 region of SEQ ID NO: 965, and a CDR3 region of SEQ ID NO: 966;

162) a binding molecule comprising a) a light-chain variable region comprising a CDR1 region of SEQ ID NO: 967, a CDR2 region of SEQ ID NO: 968, and a CDR3 region of SEQ ID NO: 969, and b) a heavy-chain variable region comprising a CDR1 region of SEQ ID NO: 970, a CDR2 region of SEQ ID NO: 971, and a CDR3 region of SEQ ID NO: 972;

163) a binding molecule comprising a) a light-chain variable region comprising a CDR1 region of SEQ ID NO: 973, a CDR2 region of SEQ ID NO: 974, and a CDR3 region of SEQ ID NO: 975, and b) a heavy-chain variable region comprising a CDR1 region of SEQ ID NO: 976, a CDR2 region of SEQ ID NO: 977, and a CDR3 region of SEQ ID NO: 978;

164) a binding molecule comprising a) a light-chain variable region comprising a CDR1 region of SEQ ID NO: 979, a CDR2 region of SEQ ID NO: 980, and a CDR3 region of SEQ ID NO: 981, and b) a heavy-chain variable region comprising a CDR1 region of SEQ ID NO: 982, a CDR2 region of SEQ ID NO: 983, and a CDR3 region of SEQ ID NO: 984;

165) a binding molecule comprising a) a light-chain variable region comprising a CDR1 region of SEQ ID NO: 985, a CDR2 region of SEQ ID NO: 986, and a CDR3 region of SEQ ID NO: 987, and b) a heavy-chain variable region comprising a CDR1 region of SEQ ID NO: 988, a CDR2 region of SEQ ID NO: 989, and a CDR3 region of SEQ ID NO: 990;

166) a binding molecule comprising a) a light-chain variable region comprising a CDR1 region of SEQ ID NO: 991, a CDR2 region of SEQ ID NO: 992, and a CDR3 region of SEQ ID NO: 993, and b) a heavy-chain variable region comprising a CDR1 region of SEQ ID NO: 994, a CDR2 region of SEQ ID NO: 995, and a CDR3 region of SEQ ID NO: 996;

167) a binding molecule comprising a) a light-chain variable region comprising a CDR1 region of SEQ ID NO: 997, a CDR2 region of SEQ ID NO: 998, and a CDR3 region of SEQ ID NO: 999, and b) a heavy-chain variable region comprising a CDR1 region of SEQ ID NO: 1000, a CDR2 region of SEQ ID NO: 1001, and a CDR3 region of SEQ ID NO: 1002;

168) a binding molecule comprising a) a light-chain variable region comprising a CDR1 region of SEQ ID NO: 1003, a CDR2 region of SEQ ID NO: 1004, and a CDR3 region of SEQ ID NO: 1005, and b) a heavy-chain variable region comprising a CDR1 region of SEQ ID NO: 1006, a CDR2 region of SEQ ID NO: 1007, and a CDR3 region of SEQ ID NO: 1008;

169) a binding molecule comprising a) a light-chain variable region comprising a CDR1 region of SEQ ID NO: 1009, a CDR2 region of SEQ ID NO: 1010, and a CDR3 region of SEQ ID NO: 1011, and b) a heavy-chain variable region comprising a CDR1 region of SEQ ID NO: 1012, a CDR2 region of SEQ ID NO: 1013, and a CDR3 region of SEQ ID NO: 1014;

170) a binding molecule comprising a) a light-chain variable region comprising a CDR1 region of SEQ ID NO: 1015, a CDR2 region of SEQ ID NO: 1016, and a CDR3 region of SEQ ID NO: 1017, and b) a heavy-chain variable region comprising a CDR1 region of SEQ ID NO: 1018, a CDR2 region of SEQ ID NO: 1019, and a CDR3 region of SEQ ID NO: 1020;

171) a binding molecule comprising a) a light-chain variable region comprising a CDR1 region of SEQ ID NO: 1021, a CDR2 region of SEQ ID NO: 1022, and a CDR3 region of SEQ ID NO: 1023, and b) a heavy-chain variable region comprising a CDR1 region of SEQ ID NO: 1024, a CDR2 region of SEQ ID NO: 1025, and a CDR3 region of SEQ ID NO: 1026;

172) a binding molecule comprising a) a light-chain variable region comprising a CDR1 region of SEQ ID NO: 1027, a CDR2 region of SEQ ID NO: 1028, and a CDR3 region of SEQ ID NO: 1029, and b) a heavy-chain variable region comprising a CDR1 region of SEQ ID NO: 1030, a CDR2 region of SEQ ID NO: 1031, and a CDR3 region of SEQ ID NO: 1032;
173) a binding molecule comprising a) a light-chain variable region comprising a CDR1 region of SEQ ID NO: 1033, a CDR2 region of SEQ ID NO: 1034, and a CDR3 region of SEQ ID NO: 1035, and b) a heavy-chain variable region comprising a CDR1 region of SEQ ID NO: 1036, a CDR2 region of SEQ ID NO: 1037, and a CDR3 region of SEQ ID NO: 1038;
174) a binding molecule comprising a) a light-chain variable region comprising a CDR1 region of SEQ ID NO: 1039, a CDR2 region of SEQ ID NO: 1040, and a CDR3 region of SEQ ID NO: 1041, and b) a heavy-chain variable region comprising a CDR1 region of SEQ ID NO: 1042, a CDR2 region of SEQ ID NO: 1043, and a CDR3 region of SEQ ID NO: 1044;
175) a binding molecule comprising a) a light-chain variable region comprising a CDR1 region of SEQ ID NO: 1045, a CDR2 region of SEQ ID NO: 1046, and a CDR3 region of SEQ ID NO: 1047, and b) a heavy-chain variable region comprising a CDR1 region of SEQ ID NO: 1048, a CDR2 region of SEQ ID NO: 1049, and a CDR3 region of SEQ ID NO: 1050;
176) a binding molecule comprising a) a light-chain variable region comprising a CDR1 region of SEQ ID NO: 1051, a CDR2 region of SEQ ID NO: 1052, and a CDR3 region of SEQ ID NO: 1053, and b) a heavy-chain variable region comprising a CDR1 region of SEQ ID NO: 1054, a CDR2 region of SEQ ID NO: 1055, and a CDR3 region of SEQ ID NO: 1056;
177) a binding molecule comprising a) a light-chain variable region comprising a CDR1 region of SEQ ID NO: 1057, a CDR2 region of SEQ ID NO: 1058, and a CDR3 region of SEQ ID NO: 1059, and b) a heavy-chain variable region comprising a CDR1 region of SEQ ID NO: 1060, a CDR2 region of SEQ ID NO: 1061, and a CDR3 region of SEQ ID NO: 1062;
178) a binding molecule comprising a) a light-chain variable region comprising a CDR1 region of SEQ ID NO: 1063, a CDR2 region of SEQ ID NO: 1064, and a CDR3 region of SEQ ID NO: 1065, and b) a heavy-chain variable region comprising a CDR1 region of SEQ ID NO: 1066, a CDR2 region of SEQ ID NO: 1067, and a CDR3 region of SEQ ID NO: 1068;
179) a binding molecule comprising a) a light-chain variable region comprising a CDR1 region of SEQ ID NO: 1069, a CDR2 region of SEQ ID NO: 1070, and a CDR3 region of SEQ ID NO: 1071, and b) a heavy-chain variable region comprising a CDR1 region of SEQ ID NO: 1072, a CDR2 region of SEQ ID NO: 1073, and a CDR3 region of SEQ ID NO: 1074;
180) a binding molecule comprising a) a light-chain variable region comprising a CDR1 region of SEQ ID NO: 1075, a CDR2 region of SEQ ID NO: 1076, and a CDR3 region of SEQ ID NO: 1077, and b) a heavy-chain variable region comprising a CDR1 region of SEQ ID NO: 1078, a CDR2 region of SEQ ID NO: 1079, and a CDR3 region of SEQ ID NO: 1080;
181) a binding molecule comprising a) a light-chain variable region comprising a CDR1 region of SEQ ID NO: 1081, a CDR2 region of SEQ ID NO: 1082, and a CDR3 region of SEQ ID NO: 1083, and b) a heavy-chain variable region comprising a CDR1 region of SEQ ID NO: 1084, a CDR2 region of SEQ ID NO: 1085, and a CDR3 region of SEQ ID NO: 1086;
182) a binding molecule comprising a) a light-chain variable region comprising a CDR1 region of SEQ ID NO: 1087, a CDR2 region of SEQ ID NO: 1088, and a CDR3 region of SEQ ID NO: 1089, and b) a heavy-chain variable region comprising a CDR1 region of SEQ ID NO: 1090, a CDR2 region of SEQ ID NO: 1091, and a CDR3 region of SEQ ID NO: 1092;
183) a binding molecule comprising a) a light-chain variable region comprising a CDR1 region of SEQ ID NO: 1093, a CDR2 region of SEQ ID NO: 1094, and a CDR3 region of SEQ ID NO: 1095, and b) a heavy-chain variable region comprising a CDR1 region of SEQ ID NO: 1096, a CDR2 region of SEQ ID NO: 1097, and a CDR3 region of SEQ ID NO: 1098;
184) a binding molecule comprising a) a light-chain variable region comprising a CDR1 region of SEQ ID NO: 1099, a CDR2 region of SEQ ID NO: 1100, and a CDR3 region of SEQ ID NO: 1101, and b) a heavy-chain variable region comprising a CDR1 region of SEQ ID NO: 1102, a CDR2 region of SEQ ID NO: 1103, and a CDR3 region of SEQ ID NO: 1104;
185) a binding molecule comprising a) a light-chain variable region comprising a CDR1 region of SEQ ID NO: 1105, a CDR2 region of SEQ ID NO: 1106, and a CDR3 region of SEQ ID NO: 1107, and b) a heavy-chain variable region comprising a CDR1 region of SEQ ID NO: 1108, a CDR2 region of SEQ ID NO: 1109, and a CDR3 region of SEQ ID NO: 1110;
186) a binding molecule comprising a) a light-chain variable region comprising a CDR1 region of SEQ ID NO: 1111, a CDR2 region of SEQ ID NO: 1112, and a CDR3 region of SEQ ID NO: 1113, and b) a heavy-chain variable region comprising a CDR1 region of SEQ ID NO: 1114, a CDR2 region of SEQ ID NO: 1115, and a CDR3 region of SEQ ID NO: 1116;
187) a binding molecule comprising a) a light-chain variable region comprising a CDR1 region of SEQ ID NO: 1117, a CDR2 region of SEQ ID NO: 1118, and a CDR3 region of SEQ ID NO: 1119, and b) a heavy-chain variable region comprising a CDR1 region of SEQ ID NO: 1120, a CDR2 region of SEQ ID NO: 1121, and a CDR3 region of SEQ ID NO: 1122;
188) a binding molecule comprising a) a light-chain variable region comprising a CDR1 region of SEQ ID NO: 1123, a CDR2 region of SEQ ID NO: 1124, and a CDR3 region of SEQ ID NO: 1125, and b) a heavy-chain variable region comprising a CDR1 region of SEQ ID NO: 1126, a CDR2 region of SEQ ID NO: 1127, and a CDR3 region of SEQ ID NO: 1128;
189) a binding molecule comprising a) a light-chain variable region comprising a CDR1 region of SEQ ID NO: 1129, a CDR2 region of SEQ ID NO: 1130, and a CDR3 region of SEQ ID NO: 1131, and b) a heavy-chain variable region comprising a CDR1 region of SEQ ID NO: 1132, a CDR2 region of SEQ ID NO: 1133, and a CDR3 region of SEQ ID NO: 1134;
190) a binding molecule comprising a) a light-chain variable region comprising a CDR1 region of SEQ ID NO: 1135, a CDR2 region of SEQ ID NO: 1136, and a CDR3 region of SEQ ID NO: 1137, and b) a heavy-chain variable region comprising a CDR1 region of SEQ ID NO: 1138, a CDR2 region of SEQ ID NO: 1139, and a CDR3 region of SEQ ID NO: 1140;
191) a binding molecule comprising a) a light-chain variable region comprising a CDR1 region of SEQ ID NO: 1141, a CDR2 region of SEQ ID NO: 1142, and a CDR3 region of SEQ ID NO: 1143, and b) a heavy-chain variable region comprising a CDR1 region of SEQ ID NO: 1144, a CDR2 region of SEQ ID NO: 1145, and a CDR3 region of SEQ ID NO: 1146;
192) a binding molecule comprising a) a light-chain variable region comprising a CDR1 region of SEQ ID NO: 1147, a CDR2 region of SEQ ID NO: 1148, and a CDR3 region of SEQ ID NO: 1149, and b) a heavy-chain variable region comprising a CDR1 region of SEQ ID NO: 1150, a CDR2 region of SEQ ID NO: 1151, and a CDR3 region of SEQ ID NO: 1152;
193) a binding molecule comprising a) a light-chain variable region comprising a CDR1 region of SEQ ID NO: 1153, a CDR2 region of SEQ ID NO: 1154, and a CDR3 region of SEQ ID NO: 1155, and b) a heavy-chain variable region comprising a CDR1 region of SEQ ID NO: 1156, a CDR2 region of SEQ ID NO: 1157, and a CDR3 region of SEQ ID NO: 1158;
194) a binding molecule comprising a) a light-chain variable region comprising a CDR1 region of SEQ ID NO: 1159, a CDR2 region of SEQ ID NO: 1160, and a CDR3 region of SEQ ID NO: 1161, and b) a heavy-chain variable region comprising a CDR1 region of SEQ ID NO: 1162, a CDR2 region of SEQ ID NO: 1163, and a CDR3 region of SEQ ID NO: 1164;
195) a binding molecule comprising a) a light-chain variable region comprising a CDR1 region of SEQ ID NO: 1165, a CDR2 region of SEQ ID NO: 1166, and a CDR3 region of SEQ ID NO: 1167, and b) a heavy-chain variable region comprising a CDR1 region of SEQ ID NO: 1168, a CDR2 region of SEQ ID NO: 1169, and a CDR3 region of SEQ ID NO: 1170;
196) a binding molecule comprising a) a light-chain variable region comprising a CDR1 region of SEQ ID NO: 1171, a CDR2 region of SEQ ID NO: 1172, and a CDR3 region of SEQ ID NO: 1173, and b) a heavy-chain variable region comprising a CDR1 region of SEQ ID NO: 1174, a CDR2 region of SEQ ID NO: 1175, and a CDR3 region of SEQ ID NO: 1176;
197) a binding molecule comprising a) a light-chain variable region comprising a CDR1 region of SEQ ID NO: 1177, a CDR2 region of SEQ ID NO: 1178, and a CDR3 region of SEQ ID NO: 1179, and b) a heavy-chain variable region comprising a CDR1 region of SEQ ID NO: 1180, a CDR2 region of SEQ ID NO: 1181, and a CDR3 region of SEQ ID NO: 1182;
198) a binding molecule comprising a) a light-chain variable region comprising a CDR1 region of SEQ ID NO: 1183, a CDR2 region of SEQ ID NO: 1184, and a CDR3 region of SEQ ID NO: 1185, and b) a heavy-chain variable region comprising a CDR1 region of SEQ ID NO: 1186, a CDR2 region of SEQ ID NO: 1187, and a CDR3 region of SEQ ID NO: 1188;
199) a binding molecule comprising a) a light-chain variable region comprising a CDR1 region of SEQ ID NO: 1189, a CDR2 region of SEQ ID NO: 1190, and a CDR3 region of SEQ ID NO: 1191, and b) a heavy-chain variable region comprising a CDR1 region of SEQ ID NO: 1192, a CDR2 region of SEQ ID NO: 1193, and a CDR3 region of SEQ ID NO: 1194;
200) a binding molecule comprising a) a light-chain variable region comprising a CDR1 region of SEQ ID NO: 1195, a CDR2 region of SEQ ID NO: 1196, and a CDR3 region of SEQ ID NO: 1197, and b) a heavy-chain variable region comprising a CDR1 region of SEQ ID NO: 1198, a CDR2 region of SEQ ID NO: 1199, and a CDR3 region of SEQ ID NO: 1200;
201) a binding molecule comprising a) a light-chain variable region comprising a CDR1 region of SEQ ID NO: 1201, a CDR2 region of SEQ ID NO: 1202, and a CDR3 region of SEQ ID NO: 1203, and b) a heavy-chain variable region comprising a CDR1 region of SEQ ID NO: 1204, a CDR2 region of SEQ ID NO: 1205, and a CDR3 region of SEQ ID NO: 1206;
202) a binding molecule comprising a) a light-chain variable region comprising a CDR1 region of SEQ ID NO: 1207, a CDR2 region of SEQ ID NO: 1208, and a CDR3 region of SEQ ID NO: 1209, and b) a heavy-chain variable region comprising a CDR1 region of SEQ ID NO: 1210, a CDR2 region of SEQ ID NO: 1211, and a CDR3 region of SEQ ID NO: 1212;
203) a binding molecule comprising a) a light-chain variable region comprising a CDR1 region of SEQ ID NO: 1213, a CDR2 region of SEQ ID NO: 1214, and a CDR3 region of SEQ ID NO: 1215, and b) a heavy-chain variable region comprising a CDR1 region of SEQ ID NO: 1216, a CDR2 region of SEQ ID NO: 1217, and a CDR3 region of SEQ ID NO: 1218;
204) a binding molecule comprising a) a light-chain variable region comprising a CDR1 region of SEQ ID NO: 1219, a CDR2 region of SEQ ID NO: 1220, and a CDR3 region of SEQ ID NO: 1221, and b) a heavy-chain variable region comprising a CDR1 region of SEQ ID NO: 1222, a CDR2 region of SEQ ID NO: 1223, and a CDR3 region of SEQ ID NO: 1224;
205) a binding molecule comprising a) a light-chain variable region comprising a CDR1 region of SEQ ID NO: 1225, a CDR2 region of SEQ ID NO: 1226, and a CDR3 region of SEQ ID NO: 1227, and b) a heavy-chain variable region comprising a CDR1 region of SEQ ID NO: 1228, a CDR2 region of SEQ ID NO: 1229, and a CDR3 region of SEQ ID NO: 1230;
206) a binding molecule comprising a) a light-chain variable region comprising a CDR1 region of SEQ ID NO: 1231, a CDR2 region of SEQ ID NO: 1232, and a CDR3 region of SEQ ID NO: 1233, and b) a heavy-chain variable region comprising a CDR1 region of SEQ ID NO: 1234, a CDR2 region of SEQ ID NO: 1235, and a CDR3 region of SEQ ID NO: 1236;
207) a binding molecule comprising a) a light-chain variable region comprising a CDR1 region of SEQ ID NO: 1237, a CDR2 region of SEQ ID NO: 1238, and a CDR3 region of SEQ ID NO: 1239, and b) a heavy-chain variable region comprising a CDR1 region of SEQ ID NO: 1240, a CDR2 region of SEQ ID NO: 1241, and a CDR3 region of SEQ ID NO: 1242;
208) a binding molecule comprising a) a light-chain variable region comprising a CDR1 region of SEQ ID NO: 1243, a CDR2 region of SEQ ID NO: 1244, and a CDR3 region of SEQ ID NO: 1245, and b) a heavy-chain variable region comprising a CDR1 region of SEQ ID NO: 1246, a CDR2 region of SEQ ID NO: 1247, and a CDR3 region of SEQ ID NO: 1248;
209) a binding molecule comprising a) a light-chain variable region comprising a CDR1 region of SEQ ID NO: 1249, a CDR2 region of SEQ ID NO: 1250, and a CDR3 region of SEQ ID NO: 1251, and b) a heavy-chain variable region comprising a CDR1 region of SEQ ID NO: 1252, a CDR2 region of SEQ ID NO: 1253, and a CDR3 region of SEQ ID NO: 1254;
210) a binding molecule comprising a) a light-chain variable region comprising a CDR1 region of SEQ ID NO: 1255, a CDR2 region of SEQ ID NO: 1256, and a CDR3 region of SEQ ID NO: 1257, and b) a heavy-chain variable region comprising a CDR1 region of SEQ ID NO: 1258, a CDR2 region of SEQ ID NO: 1259, and a CDR3 region of SEQ ID NO: 1260;

211) a binding molecule comprising a) a light-chain variable region comprising a CDR1 region of SEQ ID NO: 1261, a CDR2 region of SEQ ID NO: 1262, and a CDR3 region of SEQ ID NO: 1263, and b) a heavy-chain variable region comprising a CDR1 region of SEQ ID NO: 1264, a CDR2 region of SEQ ID NO: 1265, and a CDR3 region of SEQ ID NO: 1266;

212) a binding molecule comprising a) a light-chain variable region comprising a CDR1 region of SEQ ID NO: 1267, a CDR2 region of SEQ ID NO: 1268, and a CDR3 region of SEQ ID NO: 1269, and b) a heavy-chain variable region comprising a CDR1 region of SEQ ID NO: 1270, a CDR2 region of SEQ ID NO: 1271, and a CDR3 region of SEQ ID NO: 1272;

213) a binding molecule comprising a) a light-chain variable region comprising a CDR1 region of SEQ ID NO: 1273, a CDR2 region of SEQ ID NO: 1274, and a CDR3 region of SEQ ID NO: 1275, and b) a heavy-chain variable region comprising a CDR1 region of SEQ ID NO: 1276, a CDR2 region of SEQ ID NO: 1277, and a CDR3 region of SEQ ID NO: 1278;

214) a binding molecule comprising a) a light-chain variable region comprising a CDR1 region of SEQ ID NO: 1279, a CDR2 region of SEQ ID NO: 1280, and a CDR3 region of SEQ ID NO: 1281, and b) a heavy-chain variable region comprising a CDR1 region of SEQ ID NO: 1282, a CDR2 region of SEQ ID NO: 1283, and a CDR3 region of SEQ ID NO: 1284;

215) a binding molecule comprising a) a light-chain variable region comprising a CDR1 region of SEQ ID NO: 1285, a CDR2 region of SEQ ID NO: 1286, and a CDR3 region of SEQ ID NO: 1287, and b) a heavy-chain variable region comprising a CDR1 region of SEQ ID NO: 1288, a CDR2 region of SEQ ID NO: 1289, and a CDR3 region of SEQ ID NO: 1290;

216) a binding molecule comprising a) a light-chain variable region comprising a CDR1 region of SEQ ID NO: 1291, a CDR2 region of SEQ ID NO: 1292, and a CDR3 region of SEQ ID NO: 1293, and b) a heavy-chain variable region comprising a CDR1 region of SEQ ID NO: 1294, a CDR2 region of SEQ ID NO: 1295, and a CDR3 region of SEQ ID NO: 1296;

217) a binding molecule comprising a) a light-chain variable region comprising a CDR1 region of SEQ ID NO: 1297, a CDR2 region of SEQ ID NO: 1298, and a CDR3 region of SEQ ID NO: 1299, and b) a heavy-chain variable region comprising a CDR1 region of SEQ ID NO: 1300, a CDR2 region of SEQ ID NO: 1301, and a CDR3 region of SEQ ID NO: 1302;

218) a binding molecule comprising a) a light-chain variable region comprising a CDR1 region of SEQ ID NO: 1303, a CDR2 region of SEQ ID NO: 1304, and a CDR3 region of SEQ ID NO: 1305, and b) a heavy-chain variable region comprising a CDR1 region of SEQ ID NO: 1306, a CDR2 region of SEQ ID NO: 1307, and a CDR3 region of SEQ ID NO: 1308;

219) a binding molecule comprising a) a light-chain variable region comprising a CDR1 region of SEQ ID NO: 1309, a CDR2 region of SEQ ID NO: 1310, and a CDR3 region of SEQ ID NO: 1311, and b) a heavy-chain variable region comprising a CDR1 region of SEQ ID NO: 1312, a CDR2 region of SEQ ID NO: 1313, and a CDR3 region of SEQ ID NO: 1314;

220) a binding molecule comprising a) a light-chain variable region comprising a CDR1 region of SEQ ID NO: 1315, a CDR2 region of SEQ ID NO: 1316, and a CDR3 region of SEQ ID NO: 1317, and b) a heavy-chain variable region comprising a CDR1 region of SEQ ID NO: 1318, a CDR2 region of SEQ ID NO: 1319, and a CDR3 region of SEQ ID NO: 1320;

221) a binding molecule comprising a) a light-chain variable region comprising a CDR1 region of SEQ ID NO: 1321, a CDR2 region of SEQ ID NO: 1322, and a CDR3 region of SEQ ID NO: 1323, and b) a heavy-chain variable region comprising a CDR1 region of SEQ ID NO: 1324, a CDR2 region of SEQ ID NO: 1325, and a CDR3 region of SEQ ID NO: 1326;

222) a binding molecule comprising a) a light-chain variable region comprising a CDR1 region of SEQ ID NO: 1327, a CDR2 region of SEQ ID NO: 1328, and a CDR3 region of SEQ ID NO: 1329, and b) a heavy-chain variable region comprising a CDR1 region of SEQ ID NO: 1330, a CDR2 region of SEQ ID NO: 1331, and a CDR3 region of SEQ ID NO: 1332;

223) a binding molecule comprising a) a light-chain variable region comprising a CDR1 region of SEQ ID NO: 1333, a CDR2 region of SEQ ID NO: 1334, and a CDR3 region of SEQ ID NO: 1335, and b) a heavy-chain variable region comprising a CDR1 region of SEQ ID NO: 1336, a CDR2 region of SEQ ID NO: 1337, and a CDR3 region of SEQ ID NO: 1338;

224) a binding molecule comprising a) a light-chain variable region comprising a CDR1 region of SEQ ID NO: 1339, a CDR2 region of SEQ ID NO: 1340, and a CDR3 region of SEQ ID NO: 1341, and b) a heavy-chain variable region comprising a CDR1 region of SEQ ID NO: 1342, a CDR2 region of SEQ ID NO: 1343, and a CDR3 region of SEQ ID NO: 1344;

225) a binding molecule comprising a) a light-chain variable region comprising a CDR1 region of SEQ ID NO: 1345, a CDR2 region of SEQ ID NO: 1346, and a CDR3 region of SEQ ID NO: 1347, and b) a heavy-chain variable region comprising a CDR1 region of SEQ ID NO: 1348, a CDR2 region of SEQ ID NO: 1349, and a CDR3 region of SEQ ID NO: 1350;

226) a binding molecule comprising a) a light-chain variable region comprising a CDR1 region of SEQ ID NO: 1351, a CDR2 region of SEQ ID NO: 1352, and a CDR3 region of SEQ ID NO: 1353, and b) a heavy-chain variable region comprising a CDR1 region of SEQ ID NO: 1354, a CDR2 region of SEQ ID NO: 1355, and a CDR3 region of SEQ ID NO: 1356;

227) a binding molecule comprising a) a light-chain variable region comprising a CDR1 region of SEQ ID NO: 1357, a CDR2 region of SEQ ID NO: 1358, and a CDR3 region of SEQ ID NO: 1359, and b) a heavy-chain variable region comprising a CDR1 region of SEQ ID NO: 1360, a CDR2 region of SEQ ID NO: 1361, and a CDR3 region of SEQ ID NO: 1362;

228) a binding molecule comprising a) a light-chain variable region comprising a CDR1 region of SEQ ID NO: 1363, a CDR2 region of SEQ ID NO: 1364, and a CDR3 region of SEQ ID NO: 1365, and b) a heavy-chain variable region comprising a CDR1 region of SEQ ID NO: 1366, a CDR2 region of SEQ ID NO: 1367, and a CDR3 region of SEQ ID NO: 1368;

229) a binding molecule comprising a) a light-chain variable region comprising a CDR1 region of SEQ ID NO: 1369, a CDR2 region of SEQ ID NO: 1370, and a CDR3 region of SEQ ID NO: 1371, and b) a heavy-chain variable region comprising a CDR1 region of SEQ ID NO: 1372, a CDR2 region of SEQ ID NO: 1373, and a CDR3 region of SEQ ID NO: 1374;
230) a binding molecule comprising a) a light-chain variable region comprising a CDR1 region of SEQ ID NO: 1375, a CDR2 region of SEQ ID NO: 1376, and a CDR3 region of SEQ ID NO: 1377, and b) a heavy-chain variable region comprising a CDR1 region of SEQ ID NO: 1378, a CDR2 region of SEQ ID NO: 1379, and a CDR3 region of SEQ ID NO: 1380;
231) a binding molecule comprising a) a light-chain variable region comprising a CDR1 region of SEQ ID NO: 1381, a CDR2 region of SEQ ID NO: 1382, and a CDR3 region of SEQ ID NO: 1383, and b) a heavy-chain variable region comprising a CDR1 region of SEQ ID NO: 1384, a CDR2 region of SEQ ID NO: 1385, and a CDR3 region of SEQ ID NO: 1386;
232) a binding molecule comprising a) a light-chain variable region comprising a CDR1 region of SEQ ID NO: 1387, a CDR2 region of SEQ ID NO: 1388, and a CDR3 region of SEQ ID NO: 1389, and b) a heavy-chain variable region comprising a CDR1 region of SEQ ID NO: 1390, a CDR2 region of SEQ ID NO: 1391, and a CDR3 region of SEQ ID NO: 1392;
233) a binding molecule comprising a) a light-chain variable region comprising a CDR1 region of SEQ ID NO: 1393, a CDR2 region of SEQ ID NO: 1394, and a CDR3 region of SEQ ID NO: 1395, and b) a heavy-chain variable region comprising a CDR1 region of SEQ ID NO: 1396, a CDR2 region of SEQ ID NO: 1397, and a CDR3 region of SEQ ID NO: 1398;
234) a binding molecule comprising a) a light-chain variable region comprising a CDR1 region of SEQ ID NO: 1399, a CDR2 region of SEQ ID NO: 1400, and a CDR3 region of SEQ ID NO: 1401, and b) a heavy-chain variable region comprising a CDR1 region of SEQ ID NO: 1402, a CDR2 region of SEQ ID NO: 1403, and a CDR3 region of SEQ ID NO: 1404;
235) a binding molecule comprising a) a light-chain variable region comprising a CDR1 region of SEQ ID NO: 1405, a CDR2 region of SEQ ID NO: 1406, and a CDR3 region of SEQ ID NO: 1407, and b) a heavy-chain variable region comprising a CDR1 region of SEQ ID NO: 1408, a CDR2 region of SEQ ID NO: 1409, and a CDR3 region of SEQ ID NO: 1410;
236) a binding molecule comprising a) a light-chain variable region comprising a CDR1 region of SEQ ID NO: 1411, a CDR2 region of SEQ ID NO: 1412, and a CDR3 region of SEQ ID NO: 1413, and b) a heavy-chain variable region comprising a CDR1 region of SEQ ID NO: 1414, a CDR2 region of SEQ ID NO: 1415, and a CDR3 region of SEQ ID NO: 1416;
237) a binding molecule comprising a) a light-chain variable region comprising a CDR1 region of SEQ ID NO: 1417, a CDR2 region of SEQ ID NO: 1418, and a CDR3 region of SEQ ID NO: 1419, and b) a heavy-chain variable region comprising a CDR1 region of SEQ ID NO: 1420, a CDR2 region of SEQ ID NO: 1421, and a CDR3 region of SEQ ID NO: 1422;
238) a binding molecule comprising a) a light-chain variable region comprising a CDR1 region of SEQ ID NO: 1423, a CDR2 region of SEQ ID NO: 1424, and a CDR3 region of SEQ ID NO: 1425, and b) a heavy-chain variable region comprising a CDR1 region of SEQ ID NO: 1426, a CDR2 region of SEQ ID NO: 1427, and a CDR3 region of SEQ ID NO: 1428;
239) a binding molecule comprising a) a light-chain variable region comprising a CDR1 region of SEQ ID NO: 1429, a CDR2 region of SEQ ID NO: 1430, and a CDR3 region of SEQ ID NO: 1431, and b) a heavy-chain variable region comprising a CDR1 region of SEQ ID NO: 1432, a CDR2 region of SEQ ID NO: 1433, and a CDR3 region of SEQ ID NO: 1434;
240) a binding molecule comprising a) a light-chain variable region comprising a CDR1 region of SEQ ID NO: 1435, a CDR2 region of SEQ ID NO: 1436, and a CDR3 region of SEQ ID NO: 1437, and b) a heavy-chain variable region comprising a CDR1 region of SEQ ID NO: 1438, a CDR2 region of SEQ ID NO: 1439, and a CDR3 region of SEQ ID NO: 1440;
241) a binding molecule comprising a) a light-chain variable region comprising a CDR1 region of SEQ ID NO: 1441, a CDR2 region of SEQ ID NO: 1442, and a CDR3 region of SEQ ID NO: 1443, and b) a heavy-chain variable region comprising a CDR1 region of SEQ ID NO: 1444, a CDR2 region of SEQ ID NO: 1445, and a CDR3 region of SEQ ID NO: 1446;
242) a binding molecule comprising a) a light-chain variable region comprising a CDR1 region of SEQ ID NO: 1447, a CDR2 region of SEQ ID NO: 1448, and a CDR3 region of SEQ ID NO: 1449, and b) a heavy-chain variable region comprising a CDR1 region of SEQ ID NO: 1450, a CDR2 region of SEQ ID NO: 1451, and a CDR3 region of SEQ ID NO: 1452;
243) a binding molecule comprising a) a light-chain variable region comprising a CDR1 region of SEQ ID NO: 1453, a CDR2 region of SEQ ID NO: 1454, and a CDR3 region of SEQ ID NO: 1455, and b) a heavy-chain variable region comprising a CDR1 region of SEQ ID NO: 1456, a CDR2 region of SEQ ID NO: 1457, and a CDR3 region of SEQ ID NO: 1458;
244) a binding molecule comprising a) a light-chain variable region comprising a CDR1 region of SEQ ID NO: 1459, a CDR2 region of SEQ ID NO: 1460, and a CDR3 region of SEQ ID NO: 1461, and b) a heavy-chain variable region comprising a CDR1 region of SEQ ID NO: 1462, a CDR2 region of SEQ ID NO: 1463, and a CDR3 region of SEQ ID NO: 1464;
245) a binding molecule comprising a) a light-chain variable region comprising a CDR1 region of SEQ ID NO: 1465, a CDR2 region of SEQ ID NO: 1466, and a CDR3 region of SEQ ID NO: 1467, and b) a heavy-chain variable region comprising a CDR1 region of SEQ ID NO: 1468, a CDR2 region of SEQ ID NO: 1469, and a CDR3 region of SEQ ID NO: 1470;
246) a binding molecule comprising a) a light-chain variable region comprising a CDR1 region of SEQ ID NO: 1471, a CDR2 region of SEQ ID NO: 1472, and a CDR3 region of SEQ ID NO: 1473, and b) a heavy-chain variable region comprising a CDR1 region of SEQ ID NO: 1474, a CDR2 region of SEQ ID NO: 1475, and a CDR3 region of SEQ ID NO: 1476;
247) a binding molecule comprising a) a light-chain variable region comprising a CDR1 region of SEQ ID NO: 1477, a CDR2 region of SEQ ID NO: 1478, and a CDR3 region of SEQ ID NO: 1479, and b) a heavy-chain variable region comprising a CDR1 region of SEQ ID NO: 1480, a CDR2 region of SEQ ID NO: 1481, and a CDR3 region of SEQ ID NO: 1482;
248) a binding molecule comprising a) a light-chain variable region comprising a CDR1 region of SEQ ID NO: 1483, a CDR2 region of SEQ ID NO: 1484, and a CDR3 region of SEQ ID NO: 1485, and b) a heavy-chain variable region comprising a CDR1 region of SEQ ID NO: 1486, a CDR2 region of SEQ ID NO: 1487, and a CDR3 region of SEQ ID NO: 1488;
249) a binding molecule comprising a) a light-chain variable region comprising a CDR1 region of SEQ ID NO: 1489, a CDR2 region of SEQ ID NO: 1490, and a CDR3 region of SEQ ID NO: 1491, and b) a heavy-chain variable region comprising a CDR1 region of SEQ ID NO: 1492, a CDR2 region of SEQ ID NO: 1493, and a CDR3 region of SEQ ID NO: 1494;
250) a binding molecule comprising a) a light-chain variable region comprising a CDR1 region of SEQ ID NO: 1495, a CDR2 region of SEQ ID NO: 1496, and a CDR3 region of SEQ ID NO: 1497, and b) a heavy-chain variable region comprising a CDR1 region of SEQ ID NO: 1498, a CDR2 region of SEQ ID NO: 1499, and a CDR3 region of SEQ ID NO: 1500;
251) a binding molecule comprising a) a light-chain variable region comprising a CDR1 region of SEQ ID NO: 1501, a CDR2 region of SEQ ID NO: 1502, and a CDR3 region of SEQ ID NO: 1503, and b) a heavy-chain variable region comprising a CDR1 region of SEQ ID NO: 1504, a CDR2 region of SEQ ID NO: 1505, and a CDR3 region of SEQ ID NO: 1506;
252) a binding molecule comprising a) a light-chain variable region comprising a CDR1 region of SEQ ID NO: 1507, a CDR2 region of SEQ ID NO: 1508, and a CDR3 region of SEQ ID NO: 1509, and b) a heavy-chain variable region comprising a CDR1 region of SEQ ID NO: 1510, a CDR2 region of SEQ ID NO: 1511, and a CDR3 region of SEQ ID NO: 1512;
253) a binding molecule comprising a) a light-chain variable region comprising a CDR1 region of SEQ ID NO: 1513, a CDR2 region of SEQ ID NO: 1514, and a CDR3 region of SEQ ID NO: 1515, and b) a heavy-chain variable region comprising a CDR1 region of SEQ ID NO: 1516, a CDR2 region of SEQ ID NO: 1517, and a CDR3 region of SEQ ID NO: 1518;
254) a binding molecule comprising a) a light-chain variable region comprising a CDR1 region of SEQ ID NO: 1519, a CDR2 region of SEQ ID NO: 1520, and a CDR3 region of SEQ ID NO: 1521, and b) a heavy-chain variable region comprising a CDR1 region of SEQ ID NO: 1522, a CDR2 region of SEQ ID NO: 1523, and a CDR3 region of SEQ ID NO: 1524;
255) a binding molecule comprising a) a light-chain variable region comprising a CDR1 region of SEQ ID NO: 1525, a CDR2 region of SEQ ID NO: 1526, and a CDR3 region of SEQ ID NO: 1527, and b) a heavy-chain variable region comprising a CDR1 region of SEQ ID NO: 1528, a CDR2 region of SEQ ID NO: 1529, and a CDR3 region of SEQ ID NO: 1530;
256) a binding molecule comprising a) a light-chain variable region comprising a CDR1 region of SEQ ID NO: 1531, a CDR2 region of SEQ ID NO: 1532, and a CDR3 region of SEQ ID NO: 1533, and b) a heavy-chain variable region comprising a CDR1 region of SEQ ID NO: 1534, a CDR2 region of SEQ ID NO: 1535, and a CDR3 region of SEQ ID NO: 1536;
257) a binding molecule comprising a) a light-chain variable region comprising a CDR1 region of SEQ ID NO: 1537, a CDR2 region of SEQ ID NO: 1538, and a CDR3 region of SEQ ID NO: 1539, and b) a heavy-chain variable region comprising a CDR1 region of SEQ ID NO: 1540, a CDR2 region of SEQ ID NO: 1541, and a CDR3 region of SEQ ID NO: 1542;
258) a binding molecule comprising a) a light-chain variable region comprising a CDR1 region of SEQ ID NO: 1543, a CDR2 region of SEQ ID NO: 1544, and a CDR3 region of SEQ ID NO: 1545, and b) a heavy-chain variable region comprising a CDR1 region of SEQ ID NO: 1546, a CDR2 region of SEQ ID NO: 1547, and a CDR3 region of SEQ ID NO: 1548;
259) a binding molecule comprising a) a light-chain variable region comprising a CDR1 region of SEQ ID NO: 1549, a CDR2 region of SEQ ID NO: 1550, and a CDR3 region of SEQ ID NO: 1551, and b) a heavy-chain variable region comprising a CDR1 region of SEQ ID NO: 1552, a CDR2 region of SEQ ID NO: 1553, and a CDR3 region of SEQ ID NO: 1554;
260) a binding molecule comprising a) a light-chain variable region comprising a CDR1 region of SEQ ID NO: 1555, a CDR2 region of SEQ ID NO: 1556, and a CDR3 region of SEQ ID NO: 1557, and b) a heavy-chain variable region comprising a CDR1 region of SEQ ID NO: 1558, a CDR2 region of SEQ ID NO: 1559, and a CDR3 region of SEQ ID NO: 1560;
261) a binding molecule comprising a) a light-chain variable region comprising a CDR1 region of SEQ ID NO: 1561, a CDR2 region of SEQ ID NO: 1562, and a CDR3 region of SEQ ID NO: 1563, and b) a heavy-chain variable region comprising a CDR1 region of SEQ ID NO: 1564, a CDR2 region of SEQ ID NO: 1565, and a CDR3 region of SEQ ID NO: 1566;
262) a binding molecule comprising a) a light-chain variable region comprising a CDR1 region of SEQ ID NO: 1567, a CDR2 region of SEQ ID NO: 1568, and a CDR3 region of SEQ ID NO: 1569, and b) a heavy-chain variable region comprising a CDR1 region of SEQ ID NO: 1570, a CDR2 region of SEQ ID NO: 1571, and a CDR3 region of SEQ ID NO: 1572;
263) a binding molecule comprising a) a light-chain variable region comprising a CDR1 region of SEQ ID NO: 1573, a CDR2 region of SEQ ID NO: 1574, and a CDR3 region of SEQ ID NO: 1575, and b) a heavy-chain variable region comprising a CDR1 region of SEQ ID NO: 1576, a CDR2 region of SEQ ID NO: 1577, and a CDR3 region of SEQ ID NO: 1578;
264) a binding molecule comprising a) a light-chain variable region comprising a CDR1 region of SEQ ID NO: 1579, a CDR2 region of SEQ ID NO: 1580, and a CDR3 region of SEQ ID NO: 1581, and b) a heavy-chain variable region comprising a CDR1 region of SEQ ID NO: 1582, a CDR2 region of SEQ ID NO: 1583, and a CDR3 region of SEQ ID NO: 1584;
265) a binding molecule comprising a) a light-chain variable region comprising a CDR1 region of SEQ ID NO: 1585, a CDR2 region of SEQ ID NO: 1586, and a CDR3 region of SEQ ID NO: 1587, and b) a heavy-chain variable region comprising a CDR1 region of SEQ ID NO: 1588, a CDR2 region of SEQ ID NO: 1589, and a CDR3 region of SEQ ID NO: 1590;
266) a binding molecule comprising a) a light-chain variable region comprising a CDR1 region of SEQ ID NO: 1591, a CDR2 region of SEQ ID NO: 1592, and a CDR3 region of SEQ ID NO: 1593, and b) a heavy-chain variable region comprising a CDR1 region of SEQ ID NO: 1594, a CDR2 region of SEQ ID NO: 1595, and a CDR3 region of SEQ ID NO: 1596;
267) a binding molecule comprising a) a light-chain variable region comprising a CDR1 region of SEQ ID NO: 1597, a CDR2 region of SEQ ID NO: 1598, and a CDR3 region of SEQ ID NO: 1599, and b) a heavy-chain variable region comprising a CDR1 region of SEQ ID NO: 1600, a CDR2 region of SEQ ID NO: 1601, and a CDR3 region of SEQ ID NO: 1602;
268) a binding molecule comprising a) a light-chain variable region comprising a CDR1 region of SEQ ID NO: 1603, a CDR2 region of SEQ ID NO: 1604, and a CDR3 region of SEQ ID NO: 1605, and b) a heavy-chain variable region comprising a CDR1 region of SEQ ID NO: 1606, a CDR2 region of SEQ ID NO: 1607, and a CDR3 region of SEQ ID NO: 1608;
269) a binding molecule comprising a) a light-chain variable region comprising a CDR1 region of SEQ ID NO: 1609, a CDR2 region of SEQ ID NO: 1610, and a CDR3 region of SEQ ID NO: 1611, and b) a heavy-chain variable region comprising a CDR1 region of SEQ ID NO: 1612, a CDR2 region of SEQ ID NO: 1613, and a CDR3 region of SEQ ID NO: 1614;
270) a binding molecule comprising a) a light-chain variable region comprising a CDR1 region of SEQ ID NO: 1615, a CDR2 region of SEQ ID NO: 1616, and a CDR3 region of SEQ ID NO: 1617, and b) a heavy-chain variable region comprising a CDR1 region of SEQ ID NO: 1618, a CDR2 region of SEQ ID NO: 1619, and a CDR3 region of SEQ ID NO: 1620;
271) a binding molecule comprising a) a light-chain variable region comprising a CDR1 region of SEQ ID NO: 1621, a CDR2 region of SEQ ID NO: 1622, and a CDR3 region of SEQ ID NO: 1623, and b) a heavy-chain variable region comprising a CDR1 region of SEQ ID NO: 1624, a CDR2 region of SEQ ID NO: 1625, and a CDR3 region of SEQ ID NO: 1626;
272) a binding molecule comprising a) a light-chain variable region comprising a CDR1 region of SEQ ID NO: 1627, a CDR2 region of SEQ ID NO: 1628, and a CDR3 region of SEQ ID NO: 1629, and b) a heavy-chain variable region comprising a CDR1 region of SEQ ID NO: 1630, a CDR2 region of SEQ ID NO: 1631, and a CDR3 region of SEQ ID NO: 1632;
273) a binding molecule comprising a) a light-chain variable region comprising a CDR1 region of SEQ ID NO: 1633, a CDR2 region of SEQ ID NO: 1634, and a CDR3 region of SEQ ID NO: 1635, and b) a heavy-chain variable region comprising a CDR1 region of SEQ ID NO: 1636, a CDR2 region of SEQ ID NO: 1637, and a CDR3 region of SEQ ID NO: 1638;
274) a binding molecule comprising a) a light-chain variable region comprising a CDR1 region of SEQ ID NO: 1639, a CDR2 region of SEQ ID NO: 1640, and a CDR3 region of SEQ ID NO: 1641, and b) a heavy-chain variable region comprising a CDR1 region of SEQ ID NO: 1642, a CDR2 region of SEQ ID NO: 1643, and a CDR3 region of SEQ ID NO: 1644;
275) a binding molecule comprising a) a light-chain variable region comprising a CDR1 region of SEQ ID NO: 1645, a CDR2 region of SEQ ID NO: 1646, and a CDR3 region of SEQ ID NO: 1647, and b) a heavy-chain variable region comprising a CDR1 region of SEQ ID NO: 1648, a CDR2 region of SEQ ID NO: 1649, and a CDR3 region of SEQ ID NO: 1650;
276) a binding molecule comprising a) a light-chain variable region comprising a CDR1 region of SEQ ID NO: 1651, a CDR2 region of SEQ ID NO: 1652, and a CDR3 region of SEQ ID NO: 1653, and b) a heavy-chain variable region comprising a CDR1 region of SEQ ID NO: 1654, a CDR2 region of SEQ ID NO: 1655, and a CDR3 region of SEQ ID NO: 1656;
277) a binding molecule comprising a) a light-chain variable region comprising a CDR1 region of SEQ ID NO: 1657, a CDR2 region of SEQ ID NO: 1658, and a CDR3 region of SEQ ID NO: 1659, and b) a heavy-chain variable region comprising a CDR1 region of SEQ ID NO: 1660, a CDR2 region of SEQ ID NO: 1661, and a CDR3 region of SEQ ID NO: 1662;
278) a binding molecule comprising a) a light-chain variable region comprising a CDR1 region of SEQ ID NO: 1663, a CDR2 region of SEQ ID NO: 1664, and a CDR3 region of SEQ ID NO: 1665, and b) a heavy-chain variable region comprising a CDR1 region of SEQ ID NO: 1666, a CDR2 region of SEQ ID NO: 1667, and a CDR3 region of SEQ ID NO: 1668;
279) a binding molecule comprising a) a light-chain variable region comprising a CDR1 region of SEQ ID NO: 1669, a CDR2 region of SEQ ID NO: 1670, and a CDR3 region of SEQ ID NO: 1671, and b) a heavy-chain variable region comprising a CDR1 region of SEQ ID NO: 1672, a CDR2 region of SEQ ID NO: 1673, and a CDR3 region of SEQ ID NO: 1674;
280) a binding molecule comprising a) a light-chain variable region comprising a CDR1 region of SEQ ID NO: 1675, a CDR2 region of SEQ ID NO: 1676, and a CDR3 region of SEQ ID NO: 1677, and b) a heavy-chain variable region comprising a CDR1 region of SEQ ID NO: 1678, a CDR2 region of SEQ ID NO: 1679, and a CDR3 region of SEQ ID NO: 1680;
281) a binding molecule comprising a) a light-chain variable region comprising a CDR1 region of SEQ ID NO: 1681, a CDR2 region of SEQ ID NO: 1682, and a CDR3 region of SEQ ID NO: 1683, and b) a heavy-chain variable region comprising a CDR1 region of SEQ ID NO: 1684, a CDR2 region of SEQ ID NO: 1685, and a CDR3 region of SEQ ID NO: 1686;
282) a binding molecule comprising a) a light-chain variable region comprising a CDR1 region of SEQ ID NO: 1687, a CDR2 region of SEQ ID NO: 1688, and a CDR3 region of SEQ ID NO: 1689, and b) a heavy-chain variable region comprising a CDR1 region of SEQ ID NO: 1690, a CDR2 region of SEQ ID NO: 1691, and a CDR3 region of SEQ ID NO: 1692;
283) a binding molecule comprising a) a light-chain variable region comprising a CDR1 region of SEQ ID NO: 1693, a CDR2 region of SEQ ID NO: 1694, and a CDR3 region of SEQ ID NO: 1695, and b) a heavy-chain variable region comprising a CDR1 region of SEQ ID NO: 1696, a CDR2 region of SEQ ID NO: 1697, and a CDR3 region of SEQ ID NO: 1698;
284) a binding molecule comprising a) a light-chain variable region comprising a CDR1 region of SEQ ID NO: 1699, a CDR2 region of SEQ ID NO: 1700, and a CDR3 region of SEQ ID NO: 1701, and b) a heavy-chain variable region comprising a CDR1 region of SEQ ID NO: 1702, a CDR2 region of SEQ ID NO: 1703, and a CDR3 region of SEQ ID NO: 1704;
285) a binding molecule comprising a) a light-chain variable region comprising a CDR1 region of SEQ ID NO: 1705, a CDR2 region of SEQ ID NO: 1706, and a CDR3 region of SEQ ID NO: 1707, and b) a heavy-chain variable region comprising a CDR1 region of SEQ ID NO: 1708, a CDR2 region of SEQ ID NO: 1709, and a CDR3 region of SEQ ID NO: 1710;
286) a binding molecule comprising a) a light-chain variable region comprising a CDR1 region of SEQ ID NO: 1711, a CDR2 region of SEQ ID NO: 1712, and a CDR3 region of SEQ ID NO: 1713, and b) a heavy-chain variable region comprising a CDR1 region of SEQ ID NO: 1714, a CDR2 region of SEQ ID NO: 1715, and a CDR3 region of SEQ ID NO: 1716;

287) a binding molecule comprising a) a light-chain variable region comprising a CDR1 region of SEQ ID NO: 1717, a CDR2 region of SEQ ID NO: 1718, and a CDR3 region of SEQ ID NO: 1719, and b) a heavy-chain variable region comprising a CDR1 region of SEQ ID NO: 1720, a CDR2 region of SEQ ID NO: 1721, and a CDR3 region of SEQ ID NO: 1722;

288) a binding molecule comprising a) a light-chain variable region comprising a CDR1 region of SEQ ID NO: 1723, a CDR2 region of SEQ ID NO: 1724, and a CDR3 region of SEQ ID NO: 1725, and b) a heavy-chain variable region comprising a CDR1 region of SEQ ID NO: 1726, a CDR2 region of SEQ ID NO: 1727, and a CDR3 region of SEQ ID NO: 1728;

289) a binding molecule comprising a) a light-chain variable region comprising a CDR1 region of SEQ ID NO: 1729, a CDR2 region of SEQ ID NO: 1730, and a CDR3 region of SEQ ID NO: 1731, and b) a heavy-chain variable region comprising a CDR1 region of SEQ ID NO: 1732, a CDR2 region of SEQ ID NO: 1733, and a CDR3 region of SEQ ID NO: 1734; and 290) a binding molecule comprising a) a light-chain variable region comprising a CDR1 region of SEQ ID NO: 1735, a CDR2 region of SEQ ID NO: 1736, and a CDR3 region of SEQ ID NO: 1737, and b) a heavy-chain variable region comprising a CDR1 region of SEQ ID NO: 1738, a CDR2 region of SEQ ID NO: 1739, and a CDR3 region of SEQ ID NO: 1740.

In another embodiment of the present invention, the binding molecule includes, as a binding molecule that binds to a spike protein (S protein) on the surface of SARS-coronavirus-2 (SARS-CoV-2), a binding molecule that competes with any one binding molecule selected from the group consisting of binding molecules 1) to 106) below, or at the same time, a binding molecule that achieves the purposes and effects of the present invention is included within the scope of the present invention:

1) a binding molecule comprising a) a light-chain variable region comprising a CDR1 region of SEQ ID NO: 1, a CDR2 region of SEQ ID NO: 2, and a CDR3 region of SEQ ID NO: 3, and b) a heavy-chain variable region comprising a CDR1 region of SEQ ID NO: 4, a CDR2 region of SEQ ID NO: 5, and a CDR3 region of SEQ ID NO: 6;

2) a binding molecule comprising a) a light-chain variable region comprising a CDR1 region of SEQ ID NO: 7, a CDR2 region of SEQ ID NO: 8, and a CDR3 region of SEQ ID NO: 9, and b) a heavy-chain variable region comprising a CDR1 region of SEQ ID NO: 10, a CDR2 region of SEQ ID NO: 11, and a CDR3 region of SEQ ID NO: 12;

3) a binding molecule comprising a) a light-chain variable region comprising a CDR1 region of SEQ ID NO: 13, a CDR2 region of SEQ ID NO: 14, and a CDR3 region of SEQ ID NO: 15, and b) a heavy-chain variable region comprising a CDR1 region of SEQ ID NO: 16, a CDR2 region of SEQ ID NO: 17, and a CDR3 region of SEQ ID NO: 18;

4) a binding molecule comprising a) a light-chain variable region comprising a CDR1 region of SEQ ID NO: 19, a CDR2 region of SEQ ID NO: 20, and a CDR3 region of SEQ ID NO: 21, and b) a heavy-chain variable region comprising a CDR1 region of SEQ ID NO: 22, a CDR2 region of SEQ ID NO: 23, and a CDR3 region of SEQ ID NO: 24;

5) a binding molecule comprising a) a light-chain variable region comprising a CDR1 region of SEQ ID NO: 31, a CDR2 region of SEQ ID NO: 32, and a CDR3 region of SEQ ID NO: 33, and b) a heavy-chain variable region comprising a CDR1 region of SEQ ID NO: 34, a CDR2 region of SEQ ID NO: 35, and a CDR3 region of SEQ ID NO: 36;

6) a binding molecule comprising a) a light-chain variable region comprising a CDR1 region of SEQ ID NO: 37, a CDR2 region of SEQ ID NO: 38, and a CDR3 region of SEQ ID NO: 39, and b) a heavy-chain variable region comprising a CDR1 region of SEQ ID NO: 40, a CDR2 region of SEQ ID NO: 41, and a CDR3 region of SEQ ID NO: 42;

7) a binding molecule comprising a) a light-chain variable region comprising a CDR1 region of SEQ ID NO: 43, a CDR2 region of SEQ ID NO: 44, and a CDR3 region of SEQ ID NO: 45, and b) a heavy-chain variable region comprising a CDR1 region of SEQ ID NO: 46, a CDR2 region of SEQ ID NO: 47, and a CDR3 region of SEQ ID NO: 48;

8) a binding molecule comprising a) a light-chain variable region comprising a CDR1 region of SEQ ID NO: 49, a CDR2 region of SEQ ID NO: 50, and a CDR3 region of SEQ ID NO: 51, and b) a heavy-chain variable region comprising a CDR1 region of SEQ ID NO: 52, a CDR2 region of SEQ ID NO: 53, and a CDR3 region of SEQ ID NO: 54;

9) a binding molecule comprising a) a light-chain variable region comprising a CDR1 region of SEQ ID NO: 73, a CDR2 region of SEQ ID NO: 74, and a CDR3 region of SEQ ID NO: 75, and b) a heavy-chain variable region comprising a CDR1 region of SEQ ID NO: 76, a CDR2 region of SEQ ID NO: 77, and a CDR3 region of SEQ ID NO: 78;

10) a binding molecule comprising a) a light-chain variable region comprising a CDR1 region of SEQ ID NO: 79, a CDR2 region of SEQ ID NO: 80, and a CDR3 region of SEQ ID NO: 81, and b) a heavy-chain variable region comprising a CDR1 region of SEQ ID NO: 82, a CDR2 region of SEQ ID NO: 83, and a CDR3 region of SEQ ID NO: 84;

11) a binding molecule comprising a) a light-chain variable region comprising a CDR1 region of SEQ ID NO: 181, a CDR2 region of SEQ ID NO: 182, and a CDR3 region of SEQ ID NO: 183, and b) a heavy-chain variable region comprising a CDR1 region of SEQ ID NO: 184, a CDR2 region of SEQ ID NO: 185, and a CDR3 region of SEQ ID NO: 186;

12) a binding molecule comprising a) a light-chain variable region comprising a CDR1 region of SEQ ID NO: 259, a CDR2 region of SEQ ID NO: 260, and a CDR3 region of SEQ ID NO: 261, and b) a heavy-chain variable region comprising a CDR1 region of SEQ ID NO: 262, a CDR2 region of SEQ ID NO: 263, and a CDR3 region of SEQ ID NO: 264;

13) a binding molecule comprising a) a light-chain variable region comprising a CDR1 region of SEQ ID NO: 271, a CDR2 region of SEQ ID NO: 272, and a CDR3 region of SEQ ID NO: 273, and b) a heavy-chain variable region comprising a CDR1 region of SEQ ID NO: 274, a CDR2 region of SEQ ID NO: 275, and a CDR3 region of SEQ ID NO: 276;

14) a binding molecule comprising a) a light-chain variable region comprising a CDR1 region of SEQ ID NO: 277, a CDR2 region of SEQ ID NO: 278, and a CDR3 region of SEQ ID NO: 279, and b) a heavy-chain variable region comprising a CDR1 region of SEQ ID NO: 280, a CDR2 region of SEQ ID NO: 281, and a CDR3 region of SEQ ID NO: 282;
15) a binding molecule comprising a) a light-chain variable region comprising a CDR1 region of SEQ ID NO: 283, a CDR2 region of SEQ ID NO: 284, and a CDR3 region of SEQ ID NO: 285, and b) a heavy-chain variable region comprising a CDR1 region of SEQ ID NO: 286, a CDR2 region of SEQ ID NO: 287, and a CDR3 region of SEQ ID NO: 288;
16) a binding molecule comprising a) a light-chain variable region comprising a CDR1 region of SEQ ID NO: 289, a CDR2 region of SEQ ID NO: 290, and a CDR3 region of SEQ ID NO: 291, and b) a heavy-chain variable region comprising a CDR1 region of SEQ ID NO: 292, a CDR2 region of SEQ ID NO: 293, and a CDR3 region of SEQ ID NO: 294;
17) a binding molecule comprising a) a light-chain variable region comprising a CDR1 region of SEQ ID NO: 313, a CDR2 region of SEQ ID NO: 314, and a CDR3 region of SEQ ID NO: 315, and b) a heavy-chain variable region comprising a CDR1 region of SEQ ID NO: 316, a CDR2 region of SEQ ID NO: 317, and a CDR3 region of SEQ ID NO: 318;
18) a binding molecule comprising a) a light-chain variable region comprising a CDR1 region of SEQ ID NO: 325, a CDR2 region of SEQ ID NO: 326, and a CDR3 region of SEQ ID NO: 327, and b) a heavy-chain variable region comprising a CDR1 region of SEQ ID NO: 328, a CDR2 region of SEQ ID NO: 329, and a CDR3 region of SEQ ID NO: 330;
19) a binding molecule comprising a) a light-chain variable region comprising a CDR1 region of SEQ ID NO: 331, a CDR2 region of SEQ ID NO: 332, and a CDR3 region of SEQ ID NO: 333, and b) a heavy-chain variable region comprising a CDR1 region of SEQ ID NO: 334, a CDR2 region of SEQ ID NO: 335, and a CDR3 region of SEQ ID NO: 336;
20) a binding molecule comprising a) a light-chain variable region comprising a CDR1 region of SEQ ID NO: 385, a CDR2 region of SEQ ID NO: 386, and a CDR3 region of SEQ ID NO: 387, and b) a heavy-chain variable region comprising a CDR1 region of SEQ ID NO: 388, a CDR2 region of SEQ ID NO: 389, and a CDR3 region of SEQ ID NO: 390;
21) a binding molecule comprising a) a light-chain variable region comprising a CDR1 region of SEQ ID NO: 391, a CDR2 region of SEQ ID NO: 392, and a CDR3 region of SEQ ID NO: 393, and b) a heavy-chain variable region comprising a CDR1 region of SEQ ID NO: 394, a CDR2 region of SEQ ID NO: 395, and a CDR3 region of SEQ ID NO: 396;
22) a binding molecule comprising a) a light-chain variable region comprising a CDR1 region of SEQ ID NO: 409, a CDR2 region of SEQ ID NO: 410, and a CDR3 region of SEQ ID NO: 411, and b) a heavy-chain variable region comprising a CDR1 region of SEQ ID NO: 412, a CDR2 region of SEQ ID NO: 413, and a CDR3 region of SEQ ID NO: 414;
23) a binding molecule comprising a) a light-chain variable region comprising a CDR1 region of SEQ ID NO: 415, a CDR2 region of SEQ ID NO: 416, and a CDR3 region of SEQ ID NO: 417, and b) a heavy-chain variable region comprising a CDR1 region of SEQ ID NO: 418, a CDR2 region of SEQ ID NO: 419, and a CDR3 region of SEQ ID NO: 420;
24) a binding molecule comprising a) a light-chain variable region comprising a CDR1 region of SEQ ID NO: 421, a CDR2 region of SEQ ID NO: 422, and a CDR3 region of SEQ ID NO: 423, and b) a heavy-chain variable region comprising a CDR1 region of SEQ ID NO: 424, a CDR2 region of SEQ ID NO: 425, and a CDR3 region of SEQ ID NO: 426;
25) a binding molecule comprising a) a light-chain variable region comprising a CDR1 region of SEQ ID NO: 427, a CDR2 region of SEQ ID NO: 428, and a CDR3 region of SEQ ID NO: 429, and b) a heavy-chain variable region comprising a CDR1 region of SEQ ID NO: 430, a CDR2 region of SEQ ID NO: 431, and a CDR3 region of SEQ ID NO: 432;
26) a binding molecule comprising a) a light-chain variable region comprising a CDR1 region of SEQ ID NO: 469, a CDR2 region of SEQ ID NO: 470, and a CDR3 region of SEQ ID NO: 471, and b) a heavy-chain variable region comprising a CDR1 region of SEQ ID NO: 472, a CDR2 region of SEQ ID NO: 473, and a CDR3 region of SEQ ID NO: 474;
27) a binding molecule comprising a) a light-chain variable region comprising a CDR1 region of SEQ ID NO: 481, a CDR2 region of SEQ ID NO: 482, and a CDR3 region of SEQ ID NO: 483, and b) a heavy-chain variable region comprising a CDR1 region of SEQ ID NO: 484, a CDR2 region of SEQ ID NO: 485, and a CDR3 region of SEQ ID NO: 486;
28) a binding molecule comprising a) a light-chain variable region comprising a CDR1 region of SEQ ID NO: 493, a CDR2 region of SEQ ID NO: 494, and a CDR3 region of SEQ ID NO: 495, and b) a heavy-chain variable region comprising a CDR1 region of SEQ ID NO: 496, a CDR2 region of SEQ ID NO: 497, and a CDR3 region of SEQ ID NO: 498;
29) a binding molecule comprising a) a light-chain variable region comprising a CDR1 region of SEQ ID NO: 511, a CDR2 region of SEQ ID NO: 512, and a CDR3 region of SEQ ID NO: 513, and b) a heavy-chain variable region comprising a CDR1 region of SEQ ID NO: 514, a CDR2 region of SEQ ID NO: 515, and a CDR3 region of SEQ ID NO: 516;
30) a binding molecule comprising a) a light-chain variable region comprising a CDR1 region of SEQ ID NO: 523, a CDR2 region of SEQ ID NO: 524, and a CDR3 region of SEQ ID NO: 525, and b) a heavy-chain variable region comprising a CDR1 region of SEQ ID NO: 526, a CDR2 region of SEQ ID NO: 527, and a CDR3 region of SEQ ID NO: 528;
31) a binding molecule comprising a) a light-chain variable region comprising a CDR1 region of SEQ ID NO: 529, a CDR2 region of SEQ ID NO: 530, and a CDR3 region of SEQ ID NO: 531, and b) a heavy-chain variable region comprising a CDR1 region of SEQ ID NO: 532, a CDR2 region of SEQ ID NO: 533, and a CDR3 region of SEQ ID NO: 534;
32) a binding molecule comprising a) a light-chain variable region comprising a CDR1 region of SEQ ID NO: 535, a CDR2 region of SEQ ID NO: 536, and a CDR3 region of SEQ ID NO: 537, and b) a heavy-chain variable region comprising a CDR1 region of SEQ ID NO: 538, a CDR2 region of SEQ ID NO: 539, and a CDR3 region of SEQ ID NO: 540;

33) a binding molecule comprising a) a light-chain variable region comprising a CDR1 region of SEQ ID NO: 541, a CDR2 region of SEQ ID NO: 542, and a CDR3 region of SEQ ID NO: 543, and b) a heavy-chain variable region comprising a CDR1 region of SEQ ID NO: 544, a CDR2 region of SEQ ID NO: 545, and a CDR3 region of SEQ ID NO: 546;
34) a binding molecule comprising a) a light-chain variable region comprising a CDR1 region of SEQ ID NO: 553, a CDR2 region of SEQ ID NO: 554, and a CDR3 region of SEQ ID NO: 555, and b) a heavy-chain variable region comprising a CDR1 region of SEQ ID NO: 556, a CDR2 region of SEQ ID NO: 557, and a CDR3 region of SEQ ID NO: 558;
35) a binding molecule comprising a) a light-chain variable region comprising a CDR1 region of SEQ ID NO: 565, a CDR2 region of SEQ ID NO: 566, and a CDR3 region of SEQ ID NO: 567, and b) a heavy-chain variable region comprising a CDR1 region of SEQ ID NO: 568, a CDR2 region of SEQ ID NO: 569, and a CDR3 region of SEQ ID NO: 570;
36) a binding molecule comprising a) a light-chain variable region comprising a CDR1 region of SEQ ID NO: 613, a CDR2 region of SEQ ID NO: 614, and a CDR3 region of SEQ ID NO: 615, and b) a heavy-chain variable region comprising a CDR1 region of SEQ ID NO: 616, a CDR2 region of SEQ ID NO: 617, and a CDR3 region of SEQ ID NO: 618;
37) a binding molecule comprising a) a light-chain variable region comprising a CDR1 region of SEQ ID NO: 643, a CDR2 region of SEQ ID NO: 644, and a CDR3 region of SEQ ID NO: 645, and b) a heavy-chain variable region comprising a CDR1 region of SEQ ID NO: 646, a CDR2 region of SEQ ID NO: 647, and a CDR3 region of SEQ ID NO: 648;
38) a binding molecule comprising a) a light-chain variable region comprising a CDR1 region of SEQ ID NO: 673, a CDR2 region of SEQ ID NO: 674, and a CDR3 region of SEQ ID NO: 675, and b) a heavy-chain variable region comprising a CDR1 region of SEQ ID NO: 676, a CDR2 region of SEQ ID NO: 677, and a CDR3 region of SEQ ID NO: 678;
39) a binding molecule comprising a) a light-chain variable region comprising a CDR1 region of SEQ ID NO: 703, a CDR2 region of SEQ ID NO: 704, and a CDR3 region of SEQ ID NO: 705, and b) a heavy-chain variable region comprising a CDR1 region of SEQ ID NO: 706, a CDR2 region of SEQ ID NO: 707, and a CDR3 region of SEQ ID NO: 708;
40) a binding molecule comprising a) a light-chain variable region comprising a CDR1 region of SEQ ID NO: 763, a CDR2 region of SEQ ID NO: 764, and a CDR3 region of SEQ ID NO: 765, and b) a heavy-chain variable region comprising a CDR1 region of SEQ ID NO: 766, a CDR2 region of SEQ ID NO: 767, and a CDR3 region of SEQ ID NO: 768;
41) a binding molecule comprising a) a light-chain variable region comprising a CDR1 region of SEQ ID NO: 769, a CDR2 region of SEQ ID NO: 770, and a CDR3 region of SEQ ID NO: 771, and b) a heavy-chain variable region comprising a CDR1 region of SEQ ID NO: 772, a CDR2 region of SEQ ID NO: 773, and a CDR3 region of SEQ ID NO: 774;
42) a binding molecule comprising a) a light-chain variable region comprising a CDR1 region of SEQ ID NO: 829, a CDR2 region of SEQ ID NO: 830, and a CDR3 region of SEQ ID NO: 831, and b) a heavy-chain variable region comprising a CDR1 region of SEQ ID NO: 832, a CDR2 region of SEQ ID NO: 833, and a CDR3 region of SEQ ID NO: 834;
43) a binding molecule comprising a) a light-chain variable region comprising a CDR1 region of SEQ ID NO: 907, a CDR2 region of SEQ ID NO: 908, and a CDR3 region of SEQ ID NO: 909, and b) a heavy-chain variable region comprising a CDR1 region of SEQ ID NO: 910, a CDR2 region of SEQ ID NO: 911, and a CDR3 region of SEQ ID NO: 912;
44) a binding molecule comprising a) a light-chain variable region comprising a CDR1 region of SEQ ID NO: 1165, a CDR2 region of SEQ ID NO: 1166, and a CDR3 region of SEQ ID NO: 1167, and b) a heavy-chain variable region comprising a CDR1 region of SEQ ID NO: 1168, a CDR2 region of SEQ ID NO: 1169, and a CDR3 region of SEQ ID NO: 1170;
45) a binding molecule comprising a) a light-chain variable region comprising a CDR1 region of SEQ ID NO: 1171, a CDR2 region of SEQ ID NO: 1172, and a CDR3 region of SEQ ID NO: 1173, and b) a heavy-chain variable region comprising a CDR1 region of SEQ ID NO: 1174, a CDR2 region of SEQ ID NO: 1175, and a CDR3 region of SEQ ID NO: 1176;
46) a binding molecule comprising a) a light-chain variable region comprising a CDR1 region of SEQ ID NO: 1177, a CDR2 region of SEQ ID NO: 1178, and a CDR3 region of SEQ ID NO: 1179, and b) a heavy-chain variable region comprising a CDR1 region of SEQ ID NO: 1180, a CDR2 region of SEQ ID NO: 1181, and a CDR3 region of SEQ ID NO: 1182;
47) a binding molecule comprising a) a light-chain variable region comprising a CDR1 region of SEQ ID NO: 1201, a CDR2 region of SEQ ID NO: 1202, and a CDR3 region of SEQ ID NO: 1203, and b) a heavy-chain variable region comprising a CDR1 region of SEQ ID NO: 1204, a CDR2 region of SEQ ID NO: 1205, and a CDR3 region of SEQ ID NO: 1206;
48) a binding molecule comprising a) a light-chain variable region comprising a CDR1 region of SEQ ID NO: 1213, a CDR2 region of SEQ ID NO: 1214, and a CDR3 region of SEQ ID NO: 1215, and b) a heavy-chain variable region comprising a CDR1 region of SEQ ID NO: 1216, a CDR2 region of SEQ ID NO: 1217, and a CDR3 region of SEQ ID NO: 1218;
49) a binding molecule comprising a) a light-chain variable region comprising a CDR1 region of SEQ ID NO: 1219, a CDR2 region of SEQ ID NO: 1220, and a CDR3 region of SEQ ID NO: 1221, and b) a heavy-chain variable region comprising a CDR1 region of SEQ ID NO: 1222, a CDR2 region of SEQ ID NO: 1223, and a CDR3 region of SEQ ID NO: 1224;
50) a binding molecule comprising a) a light-chain variable region comprising a CDR1 region of SEQ ID NO: 1225, a CDR2 region of SEQ ID NO: 1226, and a CDR3 region of SEQ ID NO: 1227, and b) a heavy-chain variable region comprising a CDR1 region of SEQ ID NO: 1228, a CDR2 region of SEQ ID NO: 1229, and a CDR3 region of SEQ ID NO: 1230;
51) a binding molecule comprising a) a light-chain variable region comprising a CDR1 region of SEQ ID NO: 1231, a CDR2 region of SEQ ID NO: 1232, and a CDR3 region of SEQ ID NO: 1233, and b) a heavy-chain variable region comprising a CDR1 region of SEQ ID NO: 1234, a CDR2 region of SEQ ID NO: 1235, and a CDR3 region of SEQ ID NO: 1236;

52) a binding molecule comprising a) a light-chain variable region comprising a CDR1 region of SEQ ID NO: 1237, a CDR2 region of SEQ ID NO: 1238, and a CDR3 region of SEQ ID NO: 1239, and b) a heavy-chain variable region comprising a CDR1 region of SEQ ID NO: 1240, a CDR2 region of SEQ ID NO: 1241, and a CDR3 region of SEQ ID NO: 1242;

53) a binding molecule comprising a) a light-chain variable region comprising a CDR1 region of SEQ ID NO: 1243, a CDR2 region of SEQ ID NO: 1244, and a CDR3 region of SEQ ID NO: 1245, and b) a heavy-chain variable region comprising a CDR1 region of SEQ ID NO: 1246, a CDR2 region of SEQ ID NO: 1247, and a CDR3 region of SEQ ID NO: 1248;

54) a binding molecule comprising a) a light-chain variable region comprising a CDR1 region of SEQ ID NO: 1249, a CDR2 region of SEQ ID NO: 1250, and a CDR3 region of SEQ ID NO: 1251, and b) a heavy-chain variable region comprising a CDR1 region of SEQ ID NO: 1252, a CDR2 region of SEQ ID NO: 1253, and a CDR3 region of SEQ ID NO: 1254;

55) a binding molecule comprising a) a light-chain variable region comprising a CDR1 region of SEQ ID NO: 1267, a CDR2 region of SEQ ID NO: 1268, and a CDR3 region of SEQ ID NO: 1269, and b) a heavy-chain variable region comprising a CDR1 region of SEQ ID NO: 1270, a CDR2 region of SEQ ID NO: 1271, and a CDR3 region of SEQ ID NO: 1272;

56) a binding molecule comprising a) a light-chain variable region comprising a CDR1 region of SEQ ID NO: 1273, a CDR2 region of SEQ ID NO: 1274, and a CDR3 region of SEQ ID NO: 1275, and b) a heavy-chain variable region comprising a CDR1 region of SEQ ID NO: 1276, a CDR2 region of SEQ ID NO: 1277, and a CDR3 region of SEQ ID NO: 1278;

57) a binding molecule comprising a) a light-chain variable region comprising a CDR1 region of SEQ ID NO: 1279, a CDR2 region of SEQ ID NO: 1280, and a CDR3 region of SEQ ID NO: 1281, and b) a heavy-chain variable region comprising a CDR1 region of SEQ ID NO: 1282, a CDR2 region of SEQ ID NO: 1283, and a CDR3 region of SEQ ID NO: 1284;

58) a binding molecule comprising a) a light-chain variable region comprising a CDR1 region of SEQ ID NO: 1285, a CDR2 region of SEQ ID NO: 1286, and a CDR3 region of SEQ ID NO: 1287, and b) a heavy-chain variable region comprising a CDR1 region of SEQ ID NO: 1288, a CDR2 region of SEQ ID NO: 1289, and a CDR3 region of SEQ ID NO: 1290;

59) a binding molecule comprising a) a light-chain variable region comprising a CDR1 region of SEQ ID NO: 1291, a CDR2 region of SEQ ID NO: 1292, and a CDR3 region of SEQ ID NO: 1293, and b) a heavy-chain variable region comprising a CDR1 region of SEQ ID NO: 1294, a CDR2 region of SEQ ID NO: 1295, and a CDR3 region of SEQ ID NO: 1296;

60) a binding molecule comprising a) a light-chain variable region comprising a CDR1 region of SEQ ID NO: 1297, a CDR2 region of SEQ ID NO: 1298, and a CDR3 region of SEQ ID NO: 1299, and b) a heavy-chain variable region comprising a CDR1 region of SEQ ID NO: 1300, a CDR2 region of SEQ ID NO: 1301, and a CDR3 region of SEQ ID NO: 1302;

61) a binding molecule comprising a) a light-chain variable region comprising a CDR1 region of SEQ ID NO: 1303, a CDR2 region of SEQ ID NO: 1304, and a CDR3 region of SEQ ID NO: 1305, and b) a heavy-chain variable region comprising a CDR1 region of SEQ ID NO: 1306, a CDR2 region of SEQ ID NO: 1307, and a CDR3 region of SEQ ID NO: 1308;

62) a binding molecule comprising a) a light-chain variable region comprising a CDR1 region of SEQ ID NO: 1309, a CDR2 region of SEQ ID NO: 1310, and a CDR3 region of SEQ ID NO: 1311, and b) a heavy-chain variable region comprising a CDR1 region of SEQ ID NO: 1312, a CDR2 region of SEQ ID NO: 1313, and a CDR3 region of SEQ ID NO: 1314;

63) a binding molecule comprising a) a light-chain variable region comprising a CDR1 region of SEQ ID NO: 1315, a CDR2 region of SEQ ID NO: 1316, and a CDR3 region of SEQ ID NO: 1317, and b) a heavy-chain variable region comprising a CDR1 region of SEQ ID NO: 1318, a CDR2 region of SEQ ID NO: 1319, and a CDR3 region of SEQ ID NO: 1320;

64) a binding molecule comprising a) a light-chain variable region comprising a CDR1 region of SEQ ID NO: 1321, a CDR2 region of SEQ ID NO: 1322, and a CDR3 region of SEQ ID NO: 1323, and b) a heavy-chain variable region comprising a CDR1 region of SEQ ID NO: 1324, a CDR2 region of SEQ ID NO: 1325, and a CDR3 region of SEQ ID NO: 1326;

65) a binding molecule comprising a) a light-chain variable region comprising a CDR1 region of SEQ ID NO: 1339, a CDR2 region of SEQ ID NO: 1340, and a CDR3 region of SEQ ID NO: 1341, and b) a heavy-chain variable region comprising a CDR1 region of SEQ ID NO: 1342, a CDR2 region of SEQ ID NO: 1343, and a CDR3 region of SEQ ID NO: 1344;

66) a binding molecule comprising a) a light-chain variable region comprising a CDR1 region of SEQ ID NO: 1375, a CDR2 region of SEQ ID NO: 1376, and a CDR3 region of SEQ ID NO: 1377, and b) a heavy-chain variable region comprising a CDR1 region of SEQ ID NO: 1378, a CDR2 region of SEQ ID NO: 1379, and a CDR3 region of SEQ ID NO: 1380;

67) a binding molecule comprising a) a light-chain variable region comprising a CDR1 region of SEQ ID NO: 1387, a CDR2 region of SEQ ID NO: 1388, and a CDR3 region of SEQ ID NO: 1389, and b) a heavy-chain variable region comprising a CDR1 region of SEQ ID NO: 1390, a CDR2 region of SEQ ID NO: 1391, and a CDR3 region of SEQ ID NO: 1392;

68) a binding molecule comprising a) a light-chain variable region comprising a CDR1 region of SEQ ID NO: 1405, a CDR2 region of SEQ ID NO: 1406, and a CDR3 region of SEQ ID NO: 1407, and b) a heavy-chain variable region comprising a CDR1 region of SEQ ID NO: 1408, a CDR2 region of SEQ ID NO: 1409, and a CDR3 region of SEQ ID NO: 1410;

69) a binding molecule comprising a) a light-chain variable region comprising a CDR1 region of SEQ ID NO: 1411, a CDR2 region of SEQ ID NO: 1412, and a CDR3 region of SEQ ID NO: 1413, and b) a heavy-chain variable region comprising a CDR1 region of SEQ ID NO: 1414, a CDR2 region of SEQ ID NO: 1415, and a CDR3 region of SEQ ID NO: 1416;

70) a binding molecule comprising a) a light-chain variable region comprising a CDR1 region of SEQ ID NO: 1429, a CDR2 region of SEQ ID NO: 1430, and a CDR3 region of SEQ ID NO: 1431, and b) a heavy-chain variable region comprising a CDR1 region of SEQ ID NO: 1432, a CDR2 region of SEQ ID NO: 1433, and a CDR3 region of SEQ ID NO: 1434;

71) a binding molecule comprising a) a light-chain variable region comprising a CDR1 region of SEQ ID NO: 1441, a CDR2 region of SEQ ID NO: 1442, and a CDR3 region of SEQ ID NO: 1443, and b) a heavy-chain variable region comprising a CDR1 region of SEQ ID NO: 1444, a CDR2 region of SEQ ID NO: 1445, and a CDR3 region of SEQ ID NO: 1446;
72) a binding molecule comprising a) a light-chain variable region comprising a CDR1 region of SEQ ID NO: 1447, a CDR2 region of SEQ ID NO: 1448, and a CDR3 region of SEQ ID NO: 1449, and b) a heavy-chain variable region comprising a CDR1 region of SEQ ID NO: 1450, a CDR2 region of SEQ ID NO: 1451, and a CDR3 region of SEQ ID NO: 1452;
73) a binding molecule comprising a) a light-chain variable region comprising a CDR1 region of SEQ ID NO: 1453, a CDR2 region of SEQ ID NO: 1454, and a CDR3 region of SEQ ID NO: 1455, and b) a heavy-chain variable region comprising a CDR1 region of SEQ ID NO: 1456, a CDR2 region of SEQ ID NO: 1457, and a CDR3 region of SEQ ID NO: 1458;
74) a binding molecule comprising a) a light-chain variable region comprising a CDR1 region of SEQ ID NO: 1459, a CDR2 region of SEQ ID NO: 1460, and a CDR3 region of SEQ ID NO: 1461, and b) a heavy-chain variable region comprising a CDR1 region of SEQ ID NO: 1462, a CDR2 region of SEQ ID NO: 1463, and a CDR3 region of SEQ ID NO: 1464;
75) a binding molecule comprising a) a light-chain variable region comprising a CDR1 region of SEQ ID NO: 1465, a CDR2 region of SEQ ID NO: 1466, and a CDR3 region of SEQ ID NO: 1467, and b) a heavy-chain variable region comprising a CDR1 region of SEQ ID NO: 1468, a CDR2 region of SEQ ID NO: 1469, and a CDR3 region of SEQ ID NO: 1470;
76) a binding molecule comprising a) a light-chain variable region comprising a CDR1 region of SEQ ID NO: 1471, a CDR2 region of SEQ ID NO: 1472, and a CDR3 region of SEQ ID NO: 1473, and b) a heavy-chain variable region comprising a CDR1 region of SEQ ID NO: 1474, a CDR2 region of SEQ ID NO: 1475, and a CDR3 region of SEQ ID NO: 1476;
77) a binding molecule comprising a) a light-chain variable region comprising a CDR1 region of SEQ ID NO: 1477, a CDR2 region of SEQ ID NO: 1478, and a CDR3 region of SEQ ID NO: 1479, and b) a heavy-chain variable region comprising a CDR1 region of SEQ ID NO: 1480, a CDR2 region of SEQ ID NO: 1481, and a CDR3 region of SEQ ID NO: 1482;
78) a binding molecule comprising a) a light-chain variable region comprising a CDR1 region of SEQ ID NO: 1489, a CDR2 region of SEQ ID NO: 1490, and a CDR3 region of SEQ ID NO: 1491, and b) a heavy-chain variable region comprising a CDR1 region of SEQ ID NO: 1492, a CDR2 region of SEQ ID NO: 1493, and a CDR3 region of SEQ ID NO: 1494;
79) a binding molecule comprising a) a light-chain variable region comprising a CDR1 region of SEQ ID NO: 1495, a CDR2 region of SEQ ID NO: 1496, and a CDR3 region of SEQ ID NO: 1497, and b) a heavy-chain variable region comprising a CDR1 region of SEQ ID NO: 1498, a CDR2 region of SEQ ID NO: 1499, and a CDR3 region of SEQ ID NO: 1500;
80) a binding molecule comprising a) a light-chain variable region comprising a CDR1 region of SEQ ID NO: 1501, a CDR2 region of SEQ ID NO: 1502, and a CDR3 region of SEQ ID NO: 1503, and b) a heavy-chain variable region comprising a CDR1 region of SEQ ID NO: 1504, a CDR2 region of SEQ ID NO: 1505, and a CDR3 region of SEQ ID NO: 1506;
81) a binding molecule comprising a) a light-chain variable region comprising a CDR1 region of SEQ ID NO: 1507, a CDR2 region of SEQ ID NO: 1508, and a CDR3 region of SEQ ID NO: 1509, and b) a heavy-chain variable region comprising a CDR1 region of SEQ ID NO: 1510, a CDR2 region of SEQ ID NO: 1511, and a CDR3 region of SEQ ID NO: 1512;
82) a binding molecule comprising a) a light-chain variable region comprising a CDR1 region of SEQ ID NO: 1519, a CDR2 region of SEQ ID NO: 1520, and a CDR3 region of SEQ ID NO: 1521, and b) a heavy-chain variable region comprising a CDR1 region of SEQ ID NO: 1522, a CDR2 region of SEQ ID NO: 1523, and a CDR3 region of SEQ ID NO: 1524;
83) a binding molecule comprising a) a light-chain variable region comprising a CDR1 region of SEQ ID NO: 1531, a CDR2 region of SEQ ID NO: 1532, and a CDR3 region of SEQ ID NO: 1533, and b) a heavy-chain variable region comprising a CDR1 region of SEQ ID NO: 1534, a CDR2 region of SEQ ID NO: 1535, and a CDR3 region of SEQ ID NO: 1536;
84) a binding molecule comprising a) a light-chain variable region comprising a CDR1 region of SEQ ID NO: 1549, a CDR2 region of SEQ ID NO: 1550, and a CDR3 region of SEQ ID NO: 1551, and b) a heavy-chain variable region comprising a CDR1 region of SEQ ID NO: 1552, a CDR2 region of SEQ ID NO: 1553, and a CDR3 region of SEQ ID NO: 1554;
85) a binding molecule comprising a) a light-chain variable region comprising a CDR1 region of SEQ ID NO: 1555, a CDR2 region of SEQ ID NO: 1556, and a CDR3 region of SEQ ID NO: 1557, and b) a heavy-chain variable region comprising a CDR1 region of SEQ ID NO: 1558, a CDR2 region of SEQ ID NO: 1559, and a CDR3 region of SEQ ID NO: 1560;
86) a binding molecule comprising a) a light-chain variable region comprising a CDR1 region of SEQ ID NO: 1561, a CDR2 region of SEQ ID NO: 1562, and a CDR3 region of SEQ ID NO: 1563, and b) a heavy-chain variable region comprising a CDR1 region of SEQ ID NO: 1564, a CDR2 region of SEQ ID NO: 1565, and a CDR3 region of SEQ ID NO: 1566;
87) a binding molecule comprising a) a light-chain variable region comprising a CDR1 region of SEQ ID NO: 1573, a CDR2 region of SEQ ID NO: 1574, and a CDR3 region of SEQ ID NO: 1575, and b) a heavy-chain variable region comprising a CDR1 region of SEQ ID NO: 1576, a CDR2 region of SEQ ID NO: 1577, and a CDR3 region of SEQ ID NO: 1578;
88) a binding molecule comprising a) a light-chain variable region comprising a CDR1 region of SEQ ID NO: 1585, a CDR2 region of SEQ ID NO: 1586, and a CDR3 region of SEQ ID NO: 1587, and b) a heavy-chain variable region comprising a CDR1 region of SEQ ID NO: 1588, a CDR2 region of SEQ ID NO: 1589, and a CDR3 region of SEQ ID NO: 1590;
89) a binding molecule comprising a) a light-chain variable region comprising a CDR1 region of SEQ ID NO: 1591, a CDR2 region of SEQ ID NO: 1592, and a CDR3 region of SEQ ID NO: 1593, and b) a heavy-chain variable region comprising a CDR1 region of SEQ ID NO: 1594, a CDR2 region of SEQ ID NO: 1595, and a CDR3 region of SEQ ID NO: 1596;

90) a binding molecule comprising a) a light-chain variable region comprising a CDR1 region of SEQ ID NO: 1603, a CDR2 region of SEQ ID NO: 1604, and a CDR3 region of SEQ ID NO: 1605, and b) a heavy-chain variable region comprising a CDR1 region of SEQ ID NO: 1606, a CDR2 region of SEQ ID NO: 1607, and a CDR3 region of SEQ ID NO: 1608;

91) a binding molecule comprising a) a light-chain variable region comprising a CDR1 region of SEQ ID NO: 1615, a CDR2 region of SEQ ID NO: 1616, and a CDR3 region of SEQ ID NO: 1617, and b) a heavy-chain variable region comprising a CDR1 region of SEQ ID NO: 1618, a CDR2 region of SEQ ID NO: 1619, and a CDR3 region of SEQ ID NO: 1620;

92) a binding molecule comprising a) a light-chain variable region comprising a CDR1 region of SEQ ID NO: 1621, a CDR2 region of SEQ ID NO: 1622, and a CDR3 region of SEQ ID NO: 1623, and b) a heavy-chain variable region comprising a CDR1 region of SEQ ID NO: 1624, a CDR2 region of SEQ ID NO: 1625, and a CDR3 region of SEQ ID NO: 1626;

93) a binding molecule comprising a) a light-chain variable region comprising a CDR1 region of SEQ ID NO: 1639, a CDR2 region of SEQ ID NO: 1640, and a CDR3 region of SEQ ID NO: 1641, and b) a heavy-chain variable region comprising a CDR1 region of SEQ ID NO: 1642, a CDR2 region of SEQ ID NO: 1643, and a CDR3 region of SEQ ID NO: 1644;

94) a binding molecule comprising a) a light-chain variable region comprising a CDR1 region of SEQ ID NO: 1645, a CDR2 region of SEQ ID NO: 1646, and a CDR3 region of SEQ ID NO: 1647, and b) a heavy-chain variable region comprising a CDR1 region of SEQ ID NO: 1648, a CDR2 region of SEQ ID NO: 1649, and a CDR3 region of SEQ ID NO: 1650;

95) a binding molecule comprising a) a light-chain variable region comprising a CDR1 region of SEQ ID NO: 1651, a CDR2 region of SEQ ID NO: 1652, and a CDR3 region of SEQ ID NO: 1653, and b) a heavy-chain variable region comprising a CDR1 region of SEQ ID NO: 1654, a CDR2 region of SEQ ID NO: 1655, and a CDR3 region of SEQ ID NO: 1656;

96) a binding molecule comprising a) a light-chain variable region comprising a CDR1 region of SEQ ID NO: 1663, a CDR2 region of SEQ ID NO: 1664, and a CDR3 region of SEQ ID NO: 1665, and b) a heavy-chain variable region comprising a CDR1 region of SEQ ID NO: 1666, a CDR2 region of SEQ ID NO: 1667, and a CDR3 region of SEQ ID NO: 1668;

97) a binding molecule comprising a) a light-chain variable region comprising a CDR1 region of SEQ ID NO: 1669, a CDR2 region of SEQ ID NO: 1670, and a CDR3 region of SEQ ID NO: 1671, and b) a heavy-chain variable region comprising a CDR1 region of SEQ ID NO: 1672, a CDR2 region of SEQ ID NO: 1673, and a CDR3 region of SEQ ID NO: 1674;

98) a binding molecule comprising a) a light-chain variable region comprising a CDR1 region of SEQ ID NO: 1675, a CDR2 region of SEQ ID NO: 1676, and a CDR3 region of SEQ ID NO: 1677, and b) a heavy-chain variable region comprising a CDR1 region of SEQ ID NO: 1678, a CDR2 region of SEQ ID NO: 1679, and a CDR3 region of SEQ ID NO: 1680;

99) a binding molecule comprising a) a light-chain variable region comprising a CDR1 region of SEQ ID NO: 1681, a CDR2 region of SEQ ID NO: 1682, and a CDR3 region of SEQ ID NO: 1683, and b) a heavy-chain variable region comprising a CDR1 region of SEQ ID NO: 1684, a CDR2 region of SEQ ID NO: 1685, and a CDR3 region of SEQ ID NO: 1686;

100) a binding molecule comprising a) a light-chain variable region comprising a CDR1 region of SEQ ID NO: 1693, a CDR2 region of SEQ ID NO: 1694, and a CDR3 region of SEQ ID NO: 1695, and b) a heavy-chain variable region comprising a CDR1 region of SEQ ID NO: 1696, a CDR2 region of SEQ ID NO: 1697, and a CDR3 region of SEQ ID NO: 1698;

101) a binding molecule comprising a) a light-chain variable region comprising a CDR1 region of SEQ ID NO: 1699, a CDR2 region of SEQ ID NO: 1700, and a CDR3 region of SEQ ID NO: 1701, and b) a heavy-chain variable region comprising a CDR1 region of SEQ ID NO: 1702, a CDR2 region of SEQ ID NO: 1703, and a CDR3 region of SEQ ID NO: 1704;

102) a binding molecule comprising a) a light-chain variable region comprising a CDR1 region of SEQ ID NO: 1705, a CDR2 region of SEQ ID NO: 1706, and a CDR3 region of SEQ ID NO: 1707, and b) a heavy-chain variable region comprising a CDR1 region of SEQ ID NO: 1708, a CDR2 region of SEQ ID NO: 1709, and a CDR3 region of SEQ ID NO: 1710;

103) a binding molecule comprising a) a light-chain variable region comprising a CDR1 region of SEQ ID NO: 1717, a CDR2 region of SEQ ID NO: 1718, and a CDR3 region of SEQ ID NO: 1719, and b) a heavy-chain variable region comprising a CDR1 region of SEQ ID NO: 1720, a CDR2 region of SEQ ID NO: 1721, and a CDR3 region of SEQ ID NO: 1722;

104) a binding molecule comprising a) a light-chain variable region comprising a CDR1 region of SEQ ID NO: 1723, a CDR2 region of SEQ ID NO: 1724, and a CDR3 region of SEQ ID NO: 1725, and b) a heavy-chain variable region comprising a CDR1 region of SEQ ID NO: 1726, a CDR2 region of SEQ ID NO: 1727, and a CDR3 region of SEQ ID NO: 1728;

105) a binding molecule comprising a) a light-chain variable region comprising a CDR1 region of SEQ ID NO: 1729, a CDR2 region of SEQ ID NO: 1730, and a CDR3 region of SEQ ID NO: 1731, and b) a heavy-chain variable region comprising a CDR1 region of SEQ ID NO: 1732, a CDR2 region of SEQ ID NO: 1733, and a CDR3 region of SEQ ID NO: 1734; and 106) a binding molecule comprising a) a light-chain variable region comprising a CDR1 region of SEQ ID NO: 1735, a CDR2 region of SEQ ID NO: 1736, and a CDR3 region of SEQ ID NO: 1737, and b) a heavy-chain variable region comprising a CDR1 region of SEQ ID NO: 1738, a CDR2 region of SEQ ID NO: 1739, and a CDR3 region of SEQ ID NO: 1740.

In an embodiment of the present invention, the binding molecule includes, as a binding molecule that binds to a spike protein (S protein) on the surface of SARS-coronavirus-2 (SARS-CoV-2), a binding molecule comprising a light-chain variable region comprising LC CDR1, LC CDR2 and LC CDR3 and a heavy-chain variable region comprising HC CDR1, HC CDR2 and HC CDR3, or at the same time, a binding molecule that achieves the purposes and effects of the present invention is included within the scope of the present invention.

The LC CDR1 may comprise the sequence of SGSX$_1$SNIGX$_2$NX$_3$VX$_4$. Here, X$_1$ is S or N; X$_2$ is N, K or S, and preferably N or K; X$_3$ is Y or T; and X$_4$ is S or N, and preferably S.

The LC CDR2 may comprise the sequence of $X_4NNX_5RPS$. Here, $X_4$ is D or T, and preferably D; and $X_5$ is K or Q, and preferably K.

The LC CDR3 may comprise the sequence of $X_6X_7WDX_8X_9LX_{10}X_{11}X_{12}X_{13}$. Here, $X_6$ is G or A, and preferably G; $X_7$ is T or A, and preferably T; $X_8$ is N, S or D, and preferably N or S; $X_9$ is S or N; $X_{10}$ is S or N, and preferably S; $X_{11}$ is A or G, and preferably A; $X_{12}$ is G, V or L, and preferably G or V; and $X_{13}$ is V or R.

The HC CDR1 may comprise the sequence of TSGVGVG or DYAMH, and preferably TSGVGVG.

The HC CDR2 may comprise the sequence of LIDWDDNKYX$_{14}$TTSLKT or GIDWNSGLIGYADAVKG, and preferably LIDWDDNKYX$_{14}$TTSLKT. Here, $X_{14}$ is Y or H.

The HC CDR3 may comprise the sequence of IPGFLRYRNRYYYYGMDV or DMGSTGGYYGMDV, and preferably IPGFLRYRNRYYYYGMDV.

In an another embodiment of the present invention, the binding molecule may be a binding molecule comprising a light-chain variable region comprising LC CDR1, LC CDR2 and LC CDR3 below and a heavy-chain variable region comprising HC CDR1, HC CDR2 and HC CDR3 below.

Here, the LC CDR1 may comprise:
the sequence of RASQSISX$_{15}$YLN, in which $X_{15}$ is S or T;
the sequence of QASQDISNYLN;
the sequence of SGX$_{19}$SSNIGX$_{20}$NYVX$_{21}$, in which $X_{19}$ is S or G, $X_{20}$ is S, N or G, and $X_{21}$ is Y or H;
the sequence of RASQSX$_{28}$SX$_{29}$X$_{30}$LA, in which $X_{28}$ is V or I, $X_{29}$ is S, N or T, and $X_{30}$ is Y or N;
the sequence of RASQSVSSSYLA;
the sequence of RASQSVX$_{46}$SSX$_{47}$LA, in which $X_{46}$ is R or S, and $X_{47}$ is Y or F;
the sequence of GTSSDVGGYNYVS;
the sequence of SGX$_{51}$X$_{52}$SNIGX$_{53}$NX$_{54}$X$_{55}$S, in which $X_{51}$ is S, G or R, $X_{52}$ is S, N or T, $X_{53}$ is N, D or K, $X_{54}$ is Y or F, and $X_{55}$ is V or I;
the sequence of TGSSSNIGAGYDVH;
the sequence of SGSX$_{69}$SNX$_{70}$GX$_{71}$X$_{72}$X$_{73}$VN, in which $X_{69}$ is S, R, T or N, $X_{70}$ is I or V, $X_{71}$ is S, G or I, $X_{72}$ is N or K, and $X_{73}$ is T, A, P or S;
the sequence of X$_{94}$GSSSNX$_{95}$GAGYDVH, in which $X_{94}$ is T or S, and $X_{95}$ is I or T;
the sequence of TGSX$_{101}$SNIGAGYDVH, in which $X_{101}$ is S or D;
the sequence of SGSSSNIGSNTVN;
the sequence of SGSSX$_{113}$NIGNNYVS, in which $X_{113}$ is S or P;
the sequence of GGNNIGSKSVH; or
the sequence of X$_{120}$AX$_{121}$QX$_{122}$ISX$_{123}$YLN, in which $X_{120}$ is Q or R, $X_{121}$ is S or G, $X_{122}$ is D or S, and $X_{123}$ is N or S.

The LC CDR2 may comprise:
the sequence of AASSLQS;
the sequence of DASNLET;
the sequence of X$_{22}$NX$_{23}$QRPS, in which $X_{22}$ is R, G or S, and $X_{23}$ is N, Y or D;
the sequence of X$_{31}$X$_{32}$SX$_{33}$RAT, in which $X_{31}$ is D or G, $X_{32}$ is A or G, and $X_{33}$ is N, S or T;
the sequence of X$_{43}$ASX$_{44}$RAT, in which $X_{43}$ is G or D, and $X_{44}$ is S or N;
the sequence of X$_{48}$ASX$_{49}$RAT, in which $X_{45}$ is G or A, and $X_{49}$ is S or T;
the sequence of DVSNRPS;
the sequence of DNX$_{56}$KRPS, in which $X_{56}$ is N or D;
the sequence of GNSNRPS;
the sequence of X$_{74}$X$_{75}$X$_{76}$QRPS, in which $X_{74}$ is S or G, $X_{75}$ is N, D or S, and $X_{76}$ is N, S or D;
the sequence of SNQRPS;
the sequence of X$_{96}$NX$_{97}$X$_{98}$RPS, in which $X_{96}$ is G or S, $X_{97}$ is S or N, and $X_{98}$ is N or Q;
the sequence of X$_{102}$NX$_{103}$NRPS, in which $X_{102}$ is G or N, and $X_{103}$ is S or N;
the sequence of X$_{111}$NNQRPS, in which $X_{111}$ is S or T;
the sequence of DNX$_{114}$KRPS, in which $X_{114}$ is N or D;
the sequence of YDSDRPS; or
the sequence of X$_{124}$ASX$_{125}$LX$_{126}$X$_{127}$, in which $X_{124}$ is D, A or K, $X_{125}$ is N or S, $X_{126}$ is E or Q, and $X_{127}$ is T or S.

The LC CDR3 may comprise:
the sequence of QQSYSX$_1$iPX$_{17}$T, in which $X_{16}$ is T or, and $X_{17}$ is F or H;
the sequence of QQYDX$_{18}$LPIT, in which $X_{18}$ is N or D;
the sequence of AAWDDSLX$_{24}$GX$_{25}$V, in which $X_{24}$ is S or N, and $X_{25}$ is K or R;
the sequence of QQYX$_{34}$X$_{35}$X$_{36}$PX$_{37}$T, in which $X_{34}$ is G, V or N, $X_{35}$ is S, T or N, $X_{36}$ is S, T or W, and $X_{37}$ is L or Y;
the sequence of QQYX$_{38}$SX$_{39}$PSIT, in which $X_{38}$ is G or Y, and $X_{39}$ is S or T;
the sequence of QQYGSSPLT;
the sequence of QQYGDSLSIT;
the sequence of QEYGSSPGRVT;
the sequence of SSYTSSSTX$_{50}$V, in which $X_{50}$ is V, H or W;
the sequence of GTWDX$_{57}$X$_{58}$LSX$_{59}$X$_{60}$X$_{61}$, in which $X_{57}$ is S or N, $X_{58}$ is S or N, $X_{59}$ is A or G, $X_{60}$ is G or V, and $X_{61}$ is V or R;
the sequence of QSYDSSLSGSX$_{66}$, in which $X_{66}$ is V or I;
the sequence of X$_{77}$X$_{78}$WX$_{79}$X$_{80}$X$_{81}$X$_{82}$X$_{83}$X$_{84}$X$_{85}$V, in which $X_{77}$ is A or G, $X_{78}$ is A, T or G, $X_{79}$ is D or E, $X_{80}$ is D or S, $X_{81}$ is S, A, T or N, $X_{82}$ is L or S, $X_{83}$ is N, S, D or E, $X_{84}$ is G, S, V, A or T, and $X_{85}$ is W or Y;
the sequence of AAWDDSLX$_{99}$GX$_{100}$V, in which $X_{99}$ is N or S, and $X_{100}$ is G or W;
the sequence of QSYDSSLX$_{104}$X$_{105}$V, in which $X_{104}$ is S or G, and $X_{105}$ is G or V;
the sequence of QSX$_{106}$DSX$_{107}$LX$_{108}$GX$_{109}$V, in which $X_{106}$ is Y or S, $X_{107}$ is S or G, $X_{108}$ is S or T, and $X_{109}$ is S or W;
the sequence of AAWDDSLNGX$_{112}$V, in which $X_{112}$ is V, L or P;
the sequence of QSYDSSLSGYV;
the sequence of GTWDSSLSAX$_{115}$V, in which $X_{115}$ is Y, G or V;
the sequence of QVWDX$_{116}$SSDHX$_{117}$V, in which $X_{116}$ is S or G, and $X_{117}$ is P or Y; or
the sequence of QQX$_{128}$X$_{129}$SX$_{130}$X$_{131}$X$_{132}$T, in which $X_{128}$ is S or A, $X_{129}$ is Y or H, $X_{130}$ is T or F, $X_{131}$ is L or P, and $X_{132}$ is P or F.

The HC CDR1 may comprise:
the sequence of DYAMH;
the sequence of SYAMS;
the sequence of SYAIS;
the sequence of X$_{40}$SSYYWG, in which $X_{40}$ is S, G or R;
the sequence of SSSYYWG;
the sequence of HYFWS;
the sequence of TSGX$_{62}$GVX$_{63}$, in which $X_{62}$ is M or V, and $X_{63}$ is G or S;
the sequence of X$_{86}$X$_{87}$X$_{88}$MH, in which $X_{86}$ is R, S, N or T, $X_{87}$ is F or Y, and $X_{88}$ is A or S;

the sequence of SNYMS;
the sequence of SNYMX$_{110}$, in which X$_{110}$ is T or S;
the sequence of X$_{118}$YAMX$_{119}$, in which X$_{118}$ is D or S, and X$_{119}$ is H or S; or
the sequence of X$_{133}$YYH, in which X$_{133}$ is S or N.
The HC CDR2 may comprise:
the sequence of GISWNSGRIGYADSVKG;
the sequence of AISGSGGSTYYADSVKG;
the sequence of GIIPIFGTX$_{26}$NYAQKFQX$_{27}$, in which X$_{26}$ is A or E, and X$_{27}$ is G or D;
the sequence of X$_{41}$IX$_{42}$YSGSTYYNPSLKS, in which X$_{41}$ is N or S, and X$_{42}$ is F or Y;
the sequence of NIX$_{45}$YSGSTYYNPSLKS, in which X$_{45}$ is F or Y;
the sequence of NIFYSGSTYYNPSLKS;
the sequence of LIDWDDNKYX$_{64}$TTSLKT, in which X$_{64}$ is Y or H;
the sequence of X$_{67}$IIPILGIANYAQKFQG, in which X$_{67}$ is R or G;
the sequence of VX$_{89}$SX$_{90}$DGSNX$_{91}$YX$_{92}$AX$_{93}$SVKG, in which X$_{89}$ is I or V, X$_{90}$ is F or Y, X$_{91}$ is K or N, X$_{92}$ is Y or F, and X$_{93}$ is D or E;
the sequence of VIYSGGSTNYADSVKG;
the sequence of VIYSGGSTFYADSVKG;
the sequence of GIDWNSGLIGYADAVKG; or
the sequence of IINPSGGSTSYAQKFQG.
The HC CDR3 may comprise:
the sequence of GDCGGDCYSFLLGEDAFDI;
the sequence of SLVSGRYCSGVTCYSWFDP;
the sequence of DGVVVPAVMYDTTDPYYYGMDV;
the sequence of GSRGYYDILTGYSTGGFDY;
the sequence of IPGFLRYRNRYYYYGX$_{65}$DV, in which X$_{65}$ is M or V;
the sequence of VRGYSGYGSTYYX$_{68}$DY, in which X$_{68}$ is F or S;
the sequence of GDYYGSGSYYNPSPFFDY;
the sequence of DLIVYGMDV;
the sequence of DLVVYGMDV;
the sequence of DMGSTGGYYGMDV;
the sequence of LSHGVVGAQDAFDI; or
the sequence of GGIAPYTRGAFDY.

In another embodiment of the present invention, the binding molecule includes, as a binding molecule that binds to a spike protein (S protein) on the surface of SARS-coronavirus-2 (SARS-CoV-2), a binding molecule comprising a light-chain variable region comprising LC CDR1, LC CDR2 and LC CDR3 and a heavy-chain variable region comprising HC CDR1, HC CDR2 and HC CDR3, the binding molecule being any one selected from the group consisting of binding molecules 1) to 16) below: 1) a binding molecule, in which the LC CDR1 comprises the sequence of RASQSISX$_{15}$YLN, in which X$_{15}$ is S or T,
the LC CDR2 comprises the sequence of AASSLQS,
the LC CDR3 comprises the sequence of QQSYSX$_{16}$PX$_{17}$T, in which X$_{16}$ is T or I, and X$_{17}$ is F or H,
the HC CDR1 comprises the sequence of DYAMH,
the HC CDR2 comprises the sequence of GISWNSGRIGYADSVKG, and
the HC CDR3 comprises the sequence of GDCGGDCYSFLLGEDAFDI;
2) a binding molecule, in which the LC CDR1 comprises the sequence of QASQDISNYLN,
the LC CDR2 comprises the sequence of DASNLET,
the LC CDR3 comprises the sequence of QQYDX$_{18}$LPIT, in which X$_{18}$ is N or D,
the HC CDR1 comprises the sequence of SYAMS,
the HC CDR2 comprises the sequence of AISGSGGSTYYADSVKG, and
the HC CDR3 comprises the sequence of SLVSGRYCSGVTCYSWFDP;
3) a binding molecule, in which the LC CDR1 comprises the sequence of SGX$_{19}$SSNIGX$_{20}$NYVX$_{21}$, in which X$_{19}$ is S or G, X$_{20}$ is S, N or G, and X$_{21}$ is Y or H,
the LC CDR2 comprises the sequence of X$_{22}$NX$_{23}$QRPS, in which X$_{22}$ is R, G or S, and X$_{23}$ is N, Y or D,
the LC CDR3 comprises the sequence of AAWDDSLX$_{24}$GX$_{25}$V, in which X$_{24}$ is S or N, and X$_{25}$ is K or R,
the HC CDR1 comprises the sequence of SYAIS,
the HC CDR2 comprises the sequence of GIIPIFGTX$_{26}$NYAQKFQX$_{27}$, in which X$_{26}$ is A or E, and X$_{27}$ is G or D, and
the HC CDR3 comprises the sequence of DGVVVPAVMYDTTDPYYYGMDV;
4) a binding molecule, in which the LC CDR1 comprises the sequence of RASQSX$_{28}$SX$_{29}$X$_{30}$LA, in which X$_{28}$ is V or, X$_{29}$ is S, N or T, and X$_{30}$ is Y or N,
the LC CDR2 comprises the sequence of X$_{31}$X$_{32}$SX$_{33}$RAT, in which X$_{31}$ is D or G, X$_{32}$ is A or G, and X$_{33}$ is N, S or T,
the LC CDR3 comprises the sequence of QQYX$_{34}$X$_{35}$X$_{36}$PX$_{37}$T or QQYX$_{38}$SX$_{39}$PSIT, in which X$_{34}$ is G, V or N, X$_{35}$ is S, T or N, X$_{36}$ is S, T or W, X$_{37}$ is L or Y, X$_{38}$ is G or Y, and X$_{39}$ is S or T,
the HC CDR1 comprises the sequence of X$_{40}$SSYYWG, in which X$_{40}$ is S, and G or R,
the HC CDR2 comprises the sequence of X$_{41}$IX$_{42}$YSGSTYYNPSLKS, in which X$_{41}$ is N or S, and X$_{42}$ is F or Y, and
the HC CDR3 comprises the sequence of GSRGYYDILTGYSTGGFDY;
5) a binding molecule, in which the LC CDR1 comprises the sequence of RASQSVSSSYLA,
the LC CDR2 comprises the sequence of X$_{43}$ASX$_{44}$RAT, in which X$_{43}$ is G or D, and X$_{44}$ is S or N,
the LC CDR3 comprises the sequence of QQYGSSPLT,
the HC CDR1 comprises the sequence of SSSYYWG or HYFWS,
the HC CDR2 comprises the sequence of NIX$_{45}$YSGSTYYNPSLKS, in which X$_{45}$ is F or Y, and
the HC CDR3 comprises the sequence of GSRGYYDILTGYSTGGFDY;
6) a binding molecule, in which the LC CDR1 comprises the sequence of RASQSVX$_{46}$SSX$_{47}$LA, in which X$_{46}$ is R or S, and X$_{47}$ is Y or F,
the LC CDR2 comprises the sequence of X$_{48}$ASX$_{49}$RAT, in which X$_{48}$ is G or A, and X$_{49}$ is S or T,
the LC CDR3 comprises the sequence of QQYGDSLSIT or QEYGSSPGRVT,
the HC CDR1 comprises the sequence of SSSYYWG,
the HC CDR2 comprises the sequence of NIFYSGSTYYNPSLKS, and
the HC CDR3 comprises the sequence of GSRGYYDILTGYSTGGFDY;
7) a binding molecule, in which the LC CDR1 comprises the sequence of GTSSDVGGYNYVS,
the LC CDR2 comprises the sequence of DVSNRPS,
the LC CDR3 comprises the sequence of SSYTSSSTX$_{50}$V, in which X$_{50}$ is V, H or W,
the HC CDR1 comprises the sequence of SSSYYWG,
the HC CDR2 comprises the sequence of NIFYSGSTYYNPSLKS, and the HC CDR3 comprises the sequence of GSR-GYYDILTGYSTGGFDY;

8) a binding molecule, in which the LC CDR1 comprises the sequence of SGX$_{51}$X$_{52}$SNIGX$_{53}$NX$_{54}$X$_{55}$S, in which X$_{51}$ is S, G or R, X$_{52}$ is S, N or T, X$_{53}$ is N, D or K, X$_{54}$ is Y or F, and X$_{55}$ is V or,
the LC CDR2 comprises the sequence of DNX$_{56}$KRPS, in which X$_{56}$ is N or D,
the LC CDR3 comprises the sequence of GTWDX$_{57}$X$_{58}$LSX$_{59}$X$_{60}$X$_{61}$, in which X$_{57}$ is S or N, X$_{58}$ is S or N, X$_{59}$ is A or G, X$_{60}$ is G or V, and X$_{61}$ is V or R,
the HC CDR1 comprises the sequence of TSGX$_{62}$GVX$_{63}$, in which X$_{62}$ is M or V, and X$_{63}$ is G or S,
the HC CDR2 comprises the sequence of LIDWDDNKYX$_{64}$TTSLKT, in which X$_{64}$ is Y or H, and
the HC CDR3 comprises the sequence of IPGFLRYRNRYYYYGX$_{65}$DV, in which X$_{65}$ is M or V;

9) a binding molecule, in which the LC CDR1 comprises the sequence of TGSSSNIGAGYDVH,
the LC CDR2 comprises the sequence of GNSNRPS,
the LC CDR3 comprises the sequence of QSYDSSLSGSX$_{66}$, in which X$_{66}$ is V or I,
the HC CDR1 comprises the sequence of SYAIS,
the HC CDR2 comprises the sequence of X$_{67}$IIPILGIANYAQKFQG, in which X$_{67}$ is R or G, and
the HC CDR3 comprises the sequence of VRGYSGYGSTYYX$_{68}$DY, in which X$_{68}$ is F or S;

10) a binding molecule, in which the LC CDR1 comprises the sequence of SGSX$_{69}$SNX$_{70}$GX$_{71}$X$_{72}$X$_{73}$VN, in which X$_{69}$ is S, R, T or N, X$_{70}$ is I or V, X$_{71}$ is S, G or I, X$_{72}$ is N or K, and X$_{73}$ is T, A, P or S,
the LC CDR2 comprises the sequence of X$_{74}$X$_{75}$X$_{76}$QRPS or SNQRPS, in which X$_{74}$ is S or G, X$_{75}$ is N, D or S, and X$_{76}$ is N, S or D,
the LC CDR3 comprises the sequence of X$_{77}$X$_{78}$WX$_{79}$X$_{80}$X$_{81}$X$_{82}$X$_{83}$X$_{84}$X$_{85}$V, in which X$_{77}$ is A or G, X$_{78}$ is A, T or G, X$_{79}$ is D or E, X$_{80}$ is D or S, X$_{81}$ is S, A, T or N, X$_{82}$ is L or S, X$_{83}$ is N, S, D or E, X$_{84}$ is G, S, V, A or T, and X$_{85}$ is W or Y,
the HC CDR1 comprises the sequence of X$_{86}$X$_{87}$X$_{88}$MH, in which X$_{86}$ is R, S, N or T, X$_{87}$ is F or Y, and X$_{88}$ is A or S,
the HC CDR2 comprises the sequence of VX$_{89}$SX$_{90}$DGSNX$_{91}$YX$_{92}$AX$_{93}$SVKG, in which X$_{89}$ is I or V, X$_{90}$ is F or Y, X$_{91}$ is K or N, X$_{92}$ is Y or F, and X$_{93}$ is D or E, and
the HC CDR3 comprises the sequence of GDYYGSGSYYNPSPFFDY;

11) a binding molecule, in which the LC CDR1 comprises the sequence of X$_{94}$GSSSNX$_{95}$GAGYDVH, in which X$_{94}$ is T or S, and X$_{95}$ is I or T,
the LC CDR2 comprises the sequence of X$_{96}$NX$_{97}$X$_{98}$RPS, in which X$_{95}$ is G or S, X$_{97}$ is S or N, and X$_{98}$ is N or Q,
the LC CDR3 comprises the sequence of AAWDDSLX$_{99}$GX$_{100}$V, in which X$_{99}$ is N or S, and X$_{100}$ is G or W,
the HC CDR1 comprises the sequence of SNYMS,
the HC CDR2 comprises the sequence of VIYSGGSTNYADSVKG, and
the HC CDR3 comprises the sequence of DLIVYGMDV;

12) a binding molecule, in which the LC CDR1 comprises the sequence of TGSX$_{101}$SNIGAGYDVH, in which X$_{101}$ is S or D,
the LC CDR2 comprises the sequence of X$_{102}$NX$_{103}$NRPS, in which X$_{102}$ is G or N, and X$_{103}$ is S or N,
the LC CDR3 comprises the sequence of QSYDSSLX$_{104}$X$_{105}$V or QSX$_{106}$DSX$_{107}$LX$_{108}$GX$_{109}$V, in which X$_{104}$ is S or G, X$_{105}$ is G or V, X$_{106}$ is Y or S, X$_{107}$ is S or G, X$_{108}$ is S or T, and X$_{109}$ is S or W,
the HC CDR1 comprises the sequence of SNYMX$_{110}$, in which X$_{110}$ is T or S,
the HC CDR2 comprises the sequence of VIYSGGSTFYADSVKG, and
the HC CDR3 comprises the sequence of DLVVYGMDV;

13) a binding molecule, in which the LC CDR1 comprises the sequence of SGSSSNIGSNTVN,
the LC CDR2 comprises the sequence of X$_{111}$NNQRPS, in which X$_{111}$ is S or T,
the LC CDR3 comprises the sequence of AAWDDSLNGX$_{112}$V or QSYDSSLSGYV, in which X$_{112}$ is V, L or P,
the HC CDR1 comprises the sequence of DYAMH,
the HC CDR2 comprises the sequence of GIDWNSGLIGYADAVKG, and
the HC CDR3 comprises the sequence of DMGSTGGYYGMDV;

14) a binding molecule, in which the LC CDR1 comprises the sequence of SGSSX$_{113}$NIGNNYVS, in which X$_{113}$ is S or P,
the LC CDR2 comprises the sequence of DNX$_{114}$KRPS, in which X$_{u4}$ is N or D,
the LC CDR3 comprises the sequence of GTWDSSLSAX$_{115}$V, in which X$_{115}$ is Y, G or V,
the HC CDR1 comprises the sequence of DYAMH,
the HC CDR2 comprises the sequence of GIDWNSGLIGYADAVKG, and
the HC CDR3 comprises the sequence of DMGSTGGYYGMDV;

15) a binding molecule, in which the LC CDR1 comprises the sequence of GGNNIGSKSVH,
the LC CDR2 comprises the sequence of YDSDRPS,
the LC CDR3 comprises the sequence of QVWDX$_{116}$SSDHX$_{117}$V, in which X$_{116}$ is S or G, and X$_{117}$ is P or Y,
the HC CDR1 comprises the sequence of X$_{118}$YAMX$_{119}$, in which X$_{118}$ is D or S, and X$_{119}$ is H or S,
the HC CDR2 comprises the sequence of GIDWNSGLIGYADAVKG or AISGSGGSTYYADSVKG, and
the HC CDR3 comprises the sequence of DMGSTGGYYGMDV or LSHGVVGAQDAFDI; and 16) a binding molecule, in which the LC CDR1 comprises the sequence of X$_{120}$AX$_{121}$QX$_{122}$ISX$_{123}$YLN, in which X$_{120}$ is Q or R, X$_{121}$ is S or G, X$_{122}$ is D or S, and X$_{123}$ is N or S,
the LC CDR2 comprises the sequence of X$_{124}$ASX$_{125}$LX$_{126}$X$_{127}$, in which X$_{124}$ is D, A or K, X$_{125}$ is N or S, X$_{126}$ is E or Q, and X$_{127}$ is T or S,
the LC CDR3 comprises the sequence of QQX$_{128}$X$_{129}$SX$_{130}$X$_{131}$X$_{132}$T, in which X$_{128}$ is S or A, X$_{129}$ is Y or H, X$_{130}$ is T or F, X$_{131}$ is L or P, and X$_{132}$ is P or F,
the HC CDR1 comprises the sequence of X$_{133}$YYMH, in which X$_{133}$ is S or N,
the HC CDR2 comprises the sequence of IINPSGGSTSYAQKFQG, and the HC CDR3 comprises the sequence of GGIAPYTR-GAFDY.

In an embodiment of the present invention, the binding molecule according to the present invention may have an IC50 value evaluated according to a PRNT (plaque reduction neutralization test) method for SARS-coronavirus-2 (SARS-CoV-2) (the antibody concentration at which the antibody represents 50% of neutralizing activity against the virus) of preferably 200 ng/ml or less, more preferably 100 ng/ml or less, more preferably 50 ng/ml or less, more preferably 15 ng/ml or less, and most preferably 11 ng/ml or less, but the present invention is not limited thereto. In an exemplary embodiment of the present invention, the binding molecule according to the present invention has an IC50 value, evaluated according to a PRNT (plaque reduction neutralization test) method for all six types of SARS-CoV-2 viruses (S, G, GR, GH, V, and L types), of 10.62 ng/ml or less, indicating vastly superior neutralization activity.

In an embodiment of the present invention, the binding molecule according to the present invention may have a minimum concentration value for neutralizing the virus of 100 TCID50 for SARS-coronavirus-2 (SARS-CoV-2) of preferably 10 μg/ml or less, more preferably 5 μg/ml or less, more preferably 3.5 μg/ml or less, more preferably 2.5 μg/ml or less, and most preferably 2.0 μg/ml or less, but the present invention is not limited thereto. In an exemplary embodiment of the present invention, the binding molecule according to the present invention has a minimum concentration value for neutralizing the virus of 100 TCID50 for SARS-CoV-2 of 3.3 μg/ml or less, indicating vastly superior neutralizing activity.

In an embodiment of the present invention, the binding molecule according to the present invention is able to bind to the RBD of the spike protein of SARS-coronavirus-2 at an equilibrium dissociation constant ($K_D$) of preferably $1.0 \times 10^{-8}$ M or less, more preferably $1.0 \times 10^{-9}$ M or less, and most preferably $1.0 \times 10^{-10}$ M or less, but the present invention is not limited thereto. In an exemplary embodiment of the present invention, the binding molecule according to the present invention exhibits very high binding affinity to the RBD of the spike protein of SARS-coronavirus-2 at an equilibrium dissociation constant ($K_D$) of $1 \times 10^{-10}$ M or less.

In an embodiment of the present invention, the binding molecule according to the present invention may have a monomer content (%) determined through size exclusion chromatography (SEC-HPLC) of preferably 97% or more, more preferably 98% or more, and most preferably 99% or more, but the present invention is not limited thereto. In an exemplary embodiment of the present invention, the binding molecule according to the present invention has a monomer content (%) of 99.87% determined through SEC-HPLC, indicating very high purity.

In an embodiment of the present invention, the binding molecule according to the present invention may have purity of intact IgG determined through non-reduced capillary electrophoresis (CE) of preferably 85% or more, more preferably 86% or more, more preferably 87% or more, more preferably 88% or more, and most preferably 89% or more, but the present invention is not limited thereto. In an exemplary embodiment of the present invention, the binding molecule according to the present invention has purity of intact IgG of 89% determined through non-reduced CE, indicating very high purity.

In an embodiment of the present invention, the binding molecule according to the present invention may have the sum of heavy and light chains determined through reduced capillary electrophoresis (CE) of preferably 95% or more, more preferably 96% or more, more preferably 97% or more, more preferably 98% or more, and most preferably 99% or more, but the present invention is not limited thereto. In an exemplary embodiment of the present invention, the binding molecule according to the present invention has the sum of heavy and light chains of 99% determined through reduced CE, indicating very high purity.

In an embodiment of the present invention, the binding molecule is able to inhibit binding of coronavirus, particularly RBD (receptor-binding domain) of the spike protein of SARS-coronavirus-2 (SARS-CoV-2), and an ACE2 (angiotensin-converting enzyme 2) receptor of a target cell.

In an embodiment of the present invention, the binding molecule may be a polypeptide, particularly an antibody or an antigen-binding fragment thereof. The antibody may be a monoclonal antibody, preferably a chimeric antibody, a humanized antibody, or a human antibody, but the present invention is not limited thereto. The antigen-binding fragment may be Fab, F(ab'), F(ab')2, Fv, dAb, Fd, single-chain antibody fragment (scFv), scFv-Fc, complementarity-determining region (CDR) fragment, bivalent single-chain antibody fragment, single-chain phage antibody fragment, diabody, triabody, or tetrabody, but the present invention is not limited thereto. An embodiment of the present invention provides scFv-Fc that binds to the S protein of SARS-CoV-2. In addition, another embodiment of the present invention provides a fully human antibody (full IgG) that binds to the S protein of SARS-CoV-2.

In the present invention, the binding molecule may include those that exist in the human body and those that are not present in the human body but are wholly or partially artificially produced. In particular, the binding molecule of the present invention may be one that is wholly or partially artificially produced. Wholly or partially artificially produced examples may include those produced or isolated in vitro, those produced by mammalian cell culture, those artificially produced in a transformed cell, or those artificially produced through shuffling recombination of genetic information of light-chain and/or heavy-chain variable regions of the antibody, but the present invention is not limited thereto.

As used herein, the term "antibody" is used to have as broad a meaning as possible, and particularly includes an intact monoclonal antibody, a polyclonal antibody, a multi-specific antibody formed from two or more intact antibodies (e.g) a bispecific antibody), and an antibody fragment that shows the desired biological activity. The antibody is a protein that is produced by an immune system capable of recognizing a specific antigen and binding thereto. The antibody is typically configured to have a Y-shaped protein comprising four amino acid chains (two heavy chains and two light chains). Each antibody has two regions including a variable region and a constant region. The variable region, which is located at the ends of the arms of a Y, binds to the target antigen and interacts therewith. The variable region includes a complementarity-determining region (CDR) that recognizes the specific binding site on the specific antigen and binds thereto. The constant region, which is located at the tail of the Y, is recognized by the immune system and interacts therewith. The target antigen has a plurality of binding sites called epitopes, recognized by CDRs on antibodies. Respective antibodies specifically binding to different epitopes have different structures. Therefore, a single antigen may have at least one antibody corresponding thereto.

Moreover, the present invention includes a functional variant of the binding molecule. Such binding molecules are regarded as functional variants of the binding molecule of the present invention so long as the variants are capable of competing with the binding molecule of the present invention in order to specifically bind to SARS-CoV-2 or to an S protein thereof and also have neutralizing activity against SARS-CoV-2. Such functional variants include, but are not limited to, derivatives, the primary conformational sequences of which are substantially similar, and examples thereof include in-vitro or in-vivo modifications, chemicals and/or biochemicals, and they are not found in the parent monoclonal antibody of the present invention. Examples of such modifications may include acetylation, acylation, covalent bonding of nucleotides or nucleotide derivatives, covalent bonding of lipids or lipid derivatives, crosslinking, disulfide bonding, glycosylation, hydroxylation, methylation, oxidation, pegylation, proteolysis and phosphorylation. The functional variant may selectively be an antibody comprising an amino acid sequence resulting from subjecting at least one amino acid to substitution, insertion, deletion or combinations thereof, compared to the amino acid sequence of the parent antibody. Furthermore, the functional variant may include a truncated form of the amino acid sequence in one or both of an amino terminus and a carboxyl terminus. The functional variant of the present invention may have binding affinity the same as or different from, i.e. higher or lower than, that of the parent antibody of the present invention, but may still bind to SARS-CoV-2 or to an S protein thereof. For example, the amino acid sequence of the variable region, including, but not limited to, a framework structure or a hypervariable region, especially a CDR (complementarity-determining region) of a light chain or heavy chain, may be modified. Typically, a light-chain or heavy-chain region includes three hypervariable regions comprising three CDRs and more conserved regions, namely framework regions (FRs). The hypervariable region includes an amino acid residue from a CDR and an amino acid residue from a hypervariable loop. A functional variant that falls within the scope of the present invention may have an amino acid sequence homology of about 50% to 99%, about 60% to 99%, about 80% to 99%, about 90% to 99%, about 95% to 99%, or about 97% to 99% with the parent antibody of the present invention. In order to optimally arrange amino acid sequences to be compared, and also, in order to define similar or identical amino acid residues, among computer algorithms, Gap or Bestfit, known to those skilled in the art, may be used. The functional variant may be obtained by subjecting the parent antibody or a portion thereof to a known molecular biological process including PCR or mutagenesis/partial mutagenesis using an oligomer nucleotide, or to an organic synthesis process, but the present invention is not limited thereto.

In addition, the present invention provides an immunoconjugate in which at least one tag is additionally bound to the binding molecule. In an embodiment thereof, a drug may be additionally attached to the binding molecule. Specifically, the binding molecule according to the present invention may be used in the form of an antibody-drug conjugate containing the drug conjugated thereto. When the antibody-drug conjugate (ADC), that is, the immunoconjugate, is used to topically deliver the drug, targeted delivery of the drug moiety to infected cells becomes possible. When the drug agent is administered without being conjugated, unacceptable levels of toxicity to normal cells may be caused. By increasing not only the drug conjugation and the drug releasability but also the selectivity of the polyclonal antibody and the monoclonal antibody (mAb), maximum efficacy and minimum toxicity of ADC may be obtained.

The use of typical means for attaching the drug moiety to the antibody, for example, covalent bonding, may cause the production of heterogeneous molecular mixtures in which the drug moiety is attached to many sites on the antibody. For example, a cytotoxic drug is conjugated to the antibody through many lysine residues of the antibody to thus produce a heterogeneous antibody-drug conjugate mixture. Depending on the reaction conditions, such a heterogeneous mixture typically has a distribution whereby the number of antibodies attached to the drug moiety ranges from 0 to about 8 or more. Furthermore, each subgroup of the conjugate comprising the drug moiety and the antibody at a specific integer ratio is a potential heterogeneous mixture in which the drug moiety is attached to various sites on the antibody. Antibodies are biomolecules that are large, complicated and structurally various, and often have many reactive functional groups. The reactivity of a linker reagent and a drug-linker intermediate is dependent on factors such as pH, concentration, salt concentration, and cosolvents.

In addition, another embodiment of the present invention provides a nucleic acid molecule encoding the binding molecule.

The nucleic acid molecule of the present invention includes any nucleic acid molecule in which the amino acid sequence of the antibody provided in the present invention is translated into a polynucleotide sequence as known to those skilled in the art. Thus, various polynucleotide sequences may be prepared using an ORF (open reading frame), and may also be included in the nucleic acid molecule of the present invention.

In addition, an embodiment of the present invention provides an expression vector into which the nucleic acid molecule is inserted.

The expression vector may include, but is not limited to, any one selected from the group consisting of an expression vector available from Celltrion, such as a MarEx vector (Korean Patent No. 10-1076602), and a commercially widely useful pCDNA vector, F, R1, RP1, Col, pBR322, ToL, and Ti vector; a cosmid; phages, such as lambda, lambdoid, M13, Mu, p1 P22, Q, T-even, T2, T3, T7, etc.; and plant viruses, and any expression vector known to those skilled in the art may be used in the present invention, and the expression vector may be selected depending on the properties of the host cell of interest. The introduction of the vector into the host cell may be performed through calcium phosphate transfection, viral infection, DEAE-dextran-mediated transfection, lipofectamine transfection, or electroporation, but the present invention is not limited thereto, and those skilled in the art may adopt an introduction process suitable for the expression vector and the host cell. For example, the expression vector may contain at least one selection marker, but is not limited thereto, and selection is possible depending on whether or not the product is capable of being obtained using the vector not containing the selection marker. Choosing the selection marker depends on the host cell of interest, and is performed using any process known to those skilled in the art, and thus the present invention is not limited in connection therewith.

In order to easily purify the binding molecule of the present invention, a tag sequence may be inserted into the expression vector and thus fused therewith. The tag may include, but is not limited to, a hexa-histidine tag, a hemagglutinin tag, a myc tag or a flag tag, and any tag may be useful in the present invention so long as it facilitates purification as known to those skilled in the art.

In addition, the present invention provides a cell line transformed with the expression vector. In an embodiment of the present invention, there is provided a cell line that produces the binding molecule having ability to bind to and to neutralize SARS-CoV-2 by transforming the expression vector into a host cell.

In the present invention, the cell line may include, but is not limited to, mammals, plants, insects, fungi, or cells of cellular origin. Any one selected from the group consisting of mammalian cells, such as CHO cells, F2N cells, COS cells, BHK cells, Bowes melanoma cells, HeLa cells, 911 cells, HT1080 cells, A549 cells, HEK 293 cells and HEK293T cells may be used, but the present invention is not limited thereto, and any cells may be used, so long as they are useful as host cell for mammals, as known to those skilled in the art.

In addition, the present invention provides a composition for the diagnosis, amelioration, prevention and/or treatment of coronavirus (CoV), particularly SARS-coronavirus (SARS-CoV), particularly SARS-coronavirus-2 (SARS-CoV-2) infection or a disease caused by the infection, including at least one of the binding molecule, the immunoconjugate, the nucleic acid molecule, the expression vector, and the cell line. For example, the composition of the present invention may be a composition for the diagnosis, amelioration, prevention and/or treatment of SARS-CoV-2 infection or a disease caused by the infection, including the binding molecule, but is not limited thereto. The description of the binding molecule, the immunoconjugate, the nucleic acid molecule, the expression vector, and the cell line according to the present invention mentioned above applies equally to the composition of the present invention. The composition of the present invention may include a pharmaceutically acceptable excipient, in addition to the binding molecule. Also, as the pharmaceutically acceptable excipient contained in the composition of the present invention, examples already well known to those skilled in the art may be equally applied within a range that does not impair the purposes and effects of the present invention.

The composition of the present invention may further include at least one different therapeutic agent or diagnostic agent. For example, the composition of the present invention may further include, as an antiviral drug, interferon, an anti-S protein monoclonal antibody, an anti-S protein polyclonal antibody, a nucleoside analogue, a DNA polymerase inhibitor, a siRNA preparation or a therapeutic vaccine, in addition to the binding molecule.

The composition of the present invention including the binding molecule may be provided in the form of a formulation, such as a sterile injectable solution, a lyophilized formulation, a pre-filled syringe solution, an oral formulation, a formulation for external use or a suppository through respective typical processes, but the present invention is not limited thereto.

Also, the composition of the present invention including the binding molecule may be administered in an oral or parenteral manner. For example, the administration route may be intravenous administration, but is not limited thereto.

The composition of the present invention is administered to a mammal including a human, thereby diagnosing, ameliorating, preventing and/or treating coronavirus (CoV), particularly SARS-coronavirus (SARS-CoV), particularly SARS-coronavirus-2 (SARS-CoV-2) infection and a disease caused by the infection. Here, the amount of the binding molecule (e.g. antibody) that is administered depends on the treatment subject, severity of disease or status, administration rate and doctor's prescription, and may be, for example, 0.1 to 300 mg/kg.

In addition, the present invention provides a kit for the diagnosis, amelioration, prevention and/or treatment of coronavirus (CoV), particularly SARS-coronavirus (SARS-CoV), particularly SARS-coronavirus-2 (SARS-CoV-2) infection or a disease caused by the infection, including at least one of the binding molecule, the immunoconjugate, the nucleic acid molecule, the expression vector, and the cell line. For example, the kit of the present invention may be a kit for the diagnosis, amelioration, prevention and/or treatment of SARS-CoV-2 infection or a disease caused by the infection, including the binding molecule, but is not limited thereto. The description of the binding molecule, the immunoconjugate, the nucleic acid molecule, the expression vector, and the cell line according to the present invention mentioned above applies equally to the kit of the present invention.

In an embodiment of the present invention, the binding molecule or the like of the present invention used in the diagnostic kit may be detectably labeled. Various methods that may be used to label biomolecules are well known to those skilled in the art, and are considered to fall within the scope of the present invention. Examples of labels useful in the present invention may include enzymes, radioisotopes, colloidal metals, fluorescent compounds, chemiluminescent compounds and bioluminescent compounds. Commonly used labels include fluorescent substances (e.g. fluorescein, rhodamine, Texas red, etc.), enzymes (e.g. horseradish peroxidase, β-galactosidase, alkaline phosphatase), radioisotopes (e.g. 32P or 125I), biotin, digoxigenin, colloidal metals, or chemiluminescent or bioluminescent compounds (e.g. dioxetane, luminol or acridinium). Labeling methods such as covalent bonding, iodination, phosphorylation, biotinylation, etc. of enzymes or biotinyl groups are well known in the art. Detection methods include, but are not limited to, autoradiography, fluorescence microscopy, direct and indirect enzyme reactions, and the like. A commonly used detection assay that may be applied to the present invention is the radioisotope or non-radioisotope method. Particularly useful are western blotting, overlay analysis, RIA (radioimmunoassay), IRMA (immunoradioimmunometric assay), EIA (enzyme immunoassay), ELISA (enzyme-linked immunosorbent assay), FIA (fluorescent immunoassay) and CLIA (chemiluminescent immunoassay), but the present invention is not limited thereto.

The diagnostic kit of the present invention may be used to detect the presence or absence of SARS-CoV-2 by contacting a sample with the binding molecule and observing the reaction. The sample may be, but is not limited to, any one selected from the group consisting of sputum, saliva, blood, sweat, lung cells, mucus of lung tissue, respiratory tissue and spit of a subject, and the sample may be prepared using a process typically known to those skilled in the art.

In addition, another embodiment of the present invention provides:
  a kit for the diagnosis, prevention or treatment of a disease caused by SARS-CoV-2, including:
    a) the binding molecule; and
    b) a vessel.

In the kit for diagnosis, amelioration, prevention and/or treatment according to the present invention, a solid carrier may be included in the vessel thereof. The antibody of the present invention may be attached to the solid carrier, and the solid carrier may be porous or non-porous, or may be planar or non-planar.

In addition, the present invention provides a method of diagnosing, ameliorating, preventing and/or treating coronavirus (CoV), particularly SARS-coronavirus (SARS- CoV), particularly SARS-coronavirus-2 (SARS-CoV-2) infection or a disease caused by the infection, including administering the binding molecule, the immunoconjugate, the nucleic acid molecule, the expression vector, the cell line and/or the composition of the present invention in a therapeutically effective amount to a subject having coronavirus (CoV), particularly SARS-coronavirus (SARS-CoV), particularly SARS-coronavirus-2 (SARS-CoV-2) infection or a disease caused by the infection, or a subject suspected of or concerned about having the infection or the disease caused by the infection. For example, the method of the present invention may be a method of diagnosing, ameliorating, preventing and/or treating SARS-coronavirus-2 (SARS-CoV-2) infection or a disease caused by the infection, including administering the composition of the present invention in a therapeutically effective amount to a subject having SARS-coronavirus-2 (SARS-CoV-2) infection or a disease caused by the infection, but is not limited thereto. The description of the binding molecule, the immunoconjugate, the nucleic acid molecule, the expression vector, the cell line, and the composition according to the present invention mentioned above also equally applies to the method of the present invention.

In an embodiment of the present invention, the diagnosis, amelioration, prevention and/or treatment method may further include administering an antiviral drug, a virus entry inhibitor or a virus adhesion inhibitor.

In addition, the present invention provides a composition for the diagnosis of coronavirus (CoV), particularly SARS-coronavirus (SARS-CoV), particularly SARS-coronavirus-2 (SARS-CoV-2) infection or a disease caused by the infection, including the binding molecule described above. The composition of the present invention may include a pharmaceutically acceptable excipient, in addition to the binding molecule. In the present invention, as the pharmaceutically acceptable excipient, examples already well known to those skilled in the art may be used within a range that does not impair the purposes or effects of the present invention.

The composition of the present invention may further include at least one different diagnostic agent. For example, it may further include a binding molecule that binds to an N protein (nucleocapsid protein) on the surface of SARS-coronavirus-2 (SARS-CoV-2), in addition to the binding molecule described above.

In addition, another embodiment of the present invention provides a strip for immunochromatographic analysis, including the binding molecule that binds to coronavirus (CoV), particularly SARS-coronavirus (SARS-CoV), particularly SARS-coronavirus-2 (SARS-CoV-2), particularly a spike protein (S protein) on the surface of SARS-coronavirus-2 (SARS-CoV-2). The strip for immunochromatographic analysis may further include a binding molecule that binds to a nucleocapsid protein (N protein) of coronavirus. The coronavirus may be, but is not limited thereto, any one selected from the group consisting of SARS-coronavirus-2 (SARS-CoV-2), human coronavirus 229E (HCoV-229E), human coronavirus OC43 (HCoV-OC43), severe acute respiratory syndrome-coronavirus (SARS-CoV), human coronavirus NL63 (HCoV-NL63), human coronavirus HKU1, and Middle East respiratory syndrome-coronavirus (MERS-CoV).

The strip for immunochromatographic analysis may include:
  i) a support;
  ii) a sample pad accommodating a sample to be analyzed and including a buffer input unit and a sample input unit;
  iii) a conjugate pad containing a binding molecule that specifically binds to coronavirus contained in the sample introduced from the sample pad;
  iv) a signal detection pad including a signal detection unit for detecting whether coronavirus is present in the sample and a control unit for checking whether the sample has moved to the absorption pad regardless of the presence or absence of an analyte; and
  v) an absorbent pad for absorbing the sample for which the signal detection reaction has been completed.

The strip may be configured such that a binding molecule that binds to a spike protein (S protein) on the surface of SARS-CoV-2 is included in each of the conjugate pad and the signal detection pad. The binding molecule that binds to the S protein of SARS-CoV-2 included in the conjugate pad may be the same as or different from that included in the signal detection pad. Also, the binding molecule that binds to the S protein of SARS-CoV-2 included in each of the conjugate pad and the signal detection pad may be a binding molecule comprising the above-described sequence.

In the strip for immunochromatographic analysis, the binding molecule contained in the conjugate pad may be labeled with metal particles, latex particles, fluorescent materials or enzymes. For example, the metal particles may be gold particles. The gold particles may be colloidal gold particles, but are not limited thereto.

More specifically, the binding molecule of the present invention in the conjugate pad of the strip for immunochromatography analysis may be detectably labeled. Various methods that may be used to label biomolecules are well known to those skilled in the art, and are considered to fall within the scope of the present invention. Examples of labels useful in the present invention may include enzymes, radioisotopes, colloidal metals, fluorescent compounds, chemiluminescent compounds and bioluminescent compounds. Commonly used labels include fluorescent substances (e.g. fluorescein, rhodamine, Texas red, etc.), enzymes (e.g. horseradish peroxidase, β-galactosidase, alkaline phosphatase), radioisotopes (e.g. 32P or 125I), biotin, digoxigenin, colloidal metals, or chemiluminescent or bioluminescent compounds (e.g. dioxetane, luminol or acridinium). Labeling methods such as covalent bonding, iodination, phosphorylation, biotinylation, etc. of enzymes or biotinyl groups are well known in the art. Detection methods include, but are not limited to, autoradiography, fluorescence microscopy, direct and indirect enzyme reactions, and the like. A commonly used detection assay is the radioisotope or non-radioisotope method. Particularly useful are western blotting, overlay analysis, RIA (radioimmunoassay), IRMA (immunoradioimmunometric assay), EIA (enzyme immunoassay), ELISA (enzyme-linked immunosorbent assay), FIA (fluorescent immunoassay) and CLIA (chemiluminescent immunoassay).

In the strip for immunochromatographic analysis, the detection may be performed through observation by the naked eye or using optically, electrochemically, or electrically conductive means, but is not limited thereto.

In addition, another embodiment of the present invention provides a diagnostic kit for the diagnosis of coronavirus (CoV), particularly SARS-coronavirus (SARS-CoV), particularly SARS-coronavirus-2 (SARS-CoV-2) infection or a disease caused by the infection, including the strip for immunochromatographic analysis.

The diagnostic kit of the present invention may be used to detect the presence or absence of SARS-CoV-2 by contacting a sample with the binding molecule and observing the reaction. The sample may be, but is not limited to, any one selected from the group consisting of sputum, saliva, blood, sweat, lung cells, mucus of lung tissue, respiratory tissue and spit of a subject, and the sample may be prepared using a process typically known to those skilled in the art.

In addition, another embodiment of the present invention provides a method of detecting SARS-coronavirus-2 (SARS-CoV-2) using the diagnostic kit of the present invention.

In addition, another embodiment of the present invention provides a method of diagnosing coronavirus (CoV), particularly SARS-coronavirus (SARS-CoV), particularly SARS-coronavirus-2 (SARS-CoV-2) infection or a disease caused by the infection using the diagnostic kit of the present invention.

In addition, another embodiment of the present invention provides the use of the binding molecule for the preparation of a composition for diagnosing, ameliorating, preventing and/or treating coronavirus (CoV), particularly SARS-coronavirus (SARS-CoV), particularly SARS-coronavirus-2 (SARS-CoV-2) infection or a disease caused by the infection. The description of the binding molecule, the immunoconjugate, the nucleic acid molecule, the expression vector, the cell line, and the composition according to the present invention mentioned above applies equally to the use of the present invention.

In addition, another embodiment of the present invention provides the use of the composition for the diagnosis, amelioration, prevention and/or treatment of coronavirus (CoV), particularly SARS-coronavirus (SARS-CoV), particularly SARS-coronavirus-2 (SARS-CoV-2) infection or a disease caused by the infection, including administering the composition of the present invention in a therapeutically effective amount to a subject having coronavirus (CoV), particularly SARS-coronavirus (SARS-CoV), particularly SARS-coronavirus-2 (SARS-CoV-2) infection or a disease caused by the infection, or a subject suspected of or concerned about having the infection or the disease caused by the infection. The description of the binding molecule, the immunoconjugate, the nucleic acid molecule, the expression vector, the cell line, and the composition according to the present invention mentioned above applies equally to the use of the present invention.

In addition, another embodiment of the present invention provides a method of producing a binding molecule, including introducing a nucleic acid molecule encoding the binding molecule into a host cell, culturing the host cell under conditions that allow expression of the nucleic acid molecule, and selecting the binding molecule from the cultured host cell and/or a culture. The description of the binding molecule, the immunoconjugate, the nucleic acid molecule, the expression vector, the cell line, and the composition according to the present invention mentioned above applies equally to the production method of the present invention.

In addition, another embodiment of the present invention provides a binding molecule produced using the method of producing a binding molecule described above.

The terms used in the present invention are defined as follows.

As used herein, the term "binding molecule" refers to an intact immunoglobulin including monoclonal antibodies, such as chimeric, humanized or human monoclonal antibodies, or to an antigen-binding fragment, which is an immunoglobulin that binds to an antigen. For example, it indicates a variable domain, enzyme, receptor or protein which comprises an immunoglobulin fragment that competes with the intact immunoglobulin in order to bind to a spike protein of SARS-CoV-2. Regardless of the structure, an antigen-binding fragment binds with the same antigen that is recognized by the intact immunoglobulin. The antigen-binding fragment may comprise a peptide or polypeptide comprising an antibody amino acid sequence comprising 2 or more contiguous amino acid residues, 20 or more contiguous amino acid residues, 25 or more contiguous amino acid residues, 30 or more contiguous amino acid residues, 35 or more contiguous amino acid residues, 40 or more contiguous amino acid residues, 50 or more contiguous amino acid residues, 60 or more contiguous amino acid residues, 70 or more contiguous amino acid residues, 80 or more contiguous amino acid residues, 90 or more contiguous amino acid residues, 100 or more contiguous amino acid residues, 125 or more contiguous amino acid residues, 150 or more contiguous amino acid residues, 175 or more contiguous amino acid residues, 200 or more contiguous amino acid residues, or 250 or more contiguous amino acid residues.

As used herein, the term "antigen-binding fragment" indicates Fab, F(ab'), F(ab')2, Fv, dAb, Fd, complementarity-determining region (CDR) fragment, single-chain antibody fragment (scFv), bivalent single-chain antibody fragment, single-chain phage antibody fragment, diabody, triabody, tetrabody, polypeptide that contains at least one fragment of an immunoglobulin that is sufficient to confer specific antigen binding to the polypeptide, etc. The above fragment may be produced synthetically or through enzymatic or chemical cleavage of intact immunoglobulins, or may be genetically engineered through recombinant DNA techniques. Such production methods are well known in the art.

As used herein, the term "pharmaceutically acceptable excipient" means any inert substance that is combined with an active molecule such as a drug, agent, or antibody for preparing an acceptable or convenient dosage form. The pharmaceutically acceptable excipient is an excipient that is non-toxic or at least of reduced toxicity to recipients at typical usage dosages and concentrations, and is compatible with other ingredients of the formulation comprising the drug, agent or binding molecule.

As used herein, the term "therapeutically effective amount" refers to an amount of the binding molecule of the present invention that is effective for prevention or treatment before or after exposure to SARS-CoV-2. In an embodiment of the present invention, the therapeutically effective amount may be, for example, 0.1 to 300 mg/kg.

As used herein, the term "culture" means the maintenance, differentiation, growth, proliferation and/or reproduction of cells in vitro under suitable conditions in a medium.

As used herein, the term "comprising" or "including" means that it may further include other components in addition to the corresponding component, and is different from "consisting of" that excludes further including other additional components.

The features described herein may be used in combination, and the fact that the features are described in different dependent claims of the claims does not indicate that they cannot be used in combination.

Advantageous Effects

The binding molecule of the present invention has an excellent ability to bind to and exhibits an excellent neutralizing effect to an S protein of SARS-CoV-2 and is thus very useful for the diagnosis, prevention or treatment of SARS-coronavirus infection (COVID-19).

MODE FOR INVENTION

Figure 1:
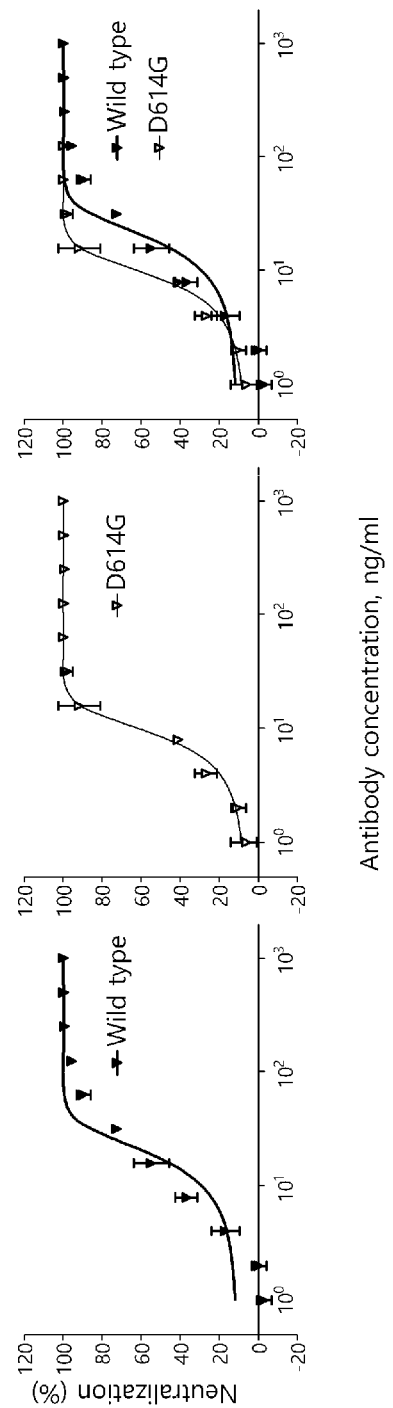
FIG. 1 shows the results of evaluation of neutralizing activity (IC50) of the binding molecule of the present invention against the Korean isolate SARS-CoV-2 (Beta-CoV/Korea/KCDC03/2020, 614D, S-type) and SARS-CoV-2 mutant virus (hCoV-19/South Korea/KUMC17/2020, 614G, G-type) using a PRNT (plaque reduction neutralization test) process.

A better understanding of the present invention may be obtained via the following examples. However, these examples are merely set forth to illustrate the present invention and are not to be construed as limiting the scope of the present invention. The documents cited herein are incorporated by reference into this application.

Example 1: Isolation of PBMC from Blood of Patient Recovered from SARS-CoV-2

Blood donors were those who were confirmed to have been infected with SARS-CoV-2 in 2020 and no longer exhibited viruses as a result of treatment (Korean adults), and the donor selection and blood collection processes were performed under the approval of the Institutional Review Board (IRB). After donor selection, about 30 ml of whole blood was collected, and PBMCs (peripheral blood mononuclear cells) were isolated using a Ficoll-Paquem PLUS (GE Healthcare) method. The isolated PBMCs were washed two times with a phosphate buffer solution and then stored in a liquid nitrogen tank at a concentration of $1\times10^7$ cells/ml in a freezing medium (RPMI:FBS:DMSO=5:4:1).

Example 2: Production of Antibody-Displayed Phage Library

Total RNA was extracted from the PBMCs isolated in Example 1 using a TRIzol Reagent (Invitrogen), after which cDNA was synthesized using a SuperScript™ III First-Strand cDNA synthesis system (Invitrogen, USA).

Production of the antibody library from the synthesized cDNA was performed with reference to the related literature (Barbas C. et. al. Phage Display: A Laboratory Manual. 2001. CSHL Press). Briefly, light-chain and heavy-chain variable regions of the antibody were amplified from the synthesized cDNA through a PCR (polymerase chain reaction) method using high-fidelity Taq polymerase (Roche) and a degenerative primer set (IDT). The isolated light-chain and heavy-chain variable-region fragments were made into an scFv gene through an overlap PCR method so as to be connected as one sequence in random combination, followed by amplification, cleavage with a restriction enzyme, and isolation of scFv using 1% agarose gel electrophoresis and a gel extraction kit (Qiagen). A phage vector was cleaved with the same restriction enzyme, isolated, mixed with the scFv gene, added with T4 DNA ligase (New England Biolabs), and then allowed to react at 16° C. for 12 hours or more. The resulting reaction solution was mixed with ER2738 competent cells, and was then transformed through an electroporation process. The transformed ER2738 was subjected to shaking culture, added with a VCSM13 helper phage (Agilent Technologies) and cultured for 12 hours or more.

Example 3: Selection Using Phage Enzyme Immunoassay

The phage library culture solution prepared in Example 2 was centrifuged to thus remove host cells, added with 4% PEG and 0.5 M NaCl, and centrifuged, so the phage was precipitated and the supernatant was removed. The precipitated phage was diluted with 1% BSA/TBS to afford a phage library, after which panning was independently performed through association to and dissociation from various SARS-CoV-2 spike proteins (S proteins), thereby isolating an scFv-phage having ability to bind to SARS-CoV-2 S protein. For example, the phage library was added to an ELISA plate to which an RBD (receptor-binding domain) (residues N331 to V524 on S1 glycoprotein), which is a portion of the SARS-CoV-2 S protein, was attached, followed by reaction at room temperature for 2 hours. The reaction solution was removed, after which the ELISA plate was washed with PBS containing 0.05% Tween 20 and then added with 60 μl of 0.1 M glycine-HCl (pH 2.2), so the scFv-phage was detached from the antigen, and neutralized using 2M Tris (pH 9.1). The scFv-phage thus neutralized was infected with ER2738, cultured with a helper phage and used for subsequent panning. A portion of the infected ER2738 was spread on an LB plate before the addition of the helper phage, and a colony was obtained the next day.

The colonies, formed each time panning was performed, were added to a culture medium in a 96-well deep well plate (Axygen), subjected to shaking culture, and added with a helper phage when $OD_{600}$ reached 0.7 or more, followed by shaking culture at 37° C. for 12 hours or more. The culture solution was centrifuged, so the host cells were removed and the supernatant containing the scFv-phage was prepared.

The scFv-phage supernatant thus prepared was diluted at 1:1 with 6% BSA/PBS, placed in each well of a 96-well microtiter plate to which SARS-CoV-2 S proteins were adsorbed and then blocked, and allowed to stand at 37° C. for 2 hours. Each well was washed three times with PBS containing 0.05% Tween 20, added with an anti-M13 antibody labeled with HRP (horseradish peroxidase), and allowed to stand at 37° C. for 1 hour. Each well was washed three times with PBS containing 0.05% Tween 20 and then added with ABTS (2,2'-azinobis[3-ethylbenzothiazoline-6-sulfonic acid]-diammonium salt), after which absorbance was measured at 405 nm, whereby scFv-phages having ability to bind to SARS-CoV-2 S antigen proteins were selected.

Example 4: Confirmation of Binding Ability of scFv-Fc Antibody Fragment

For the scFv-phages selected in Example 3, DNA was obtained through shaking culture of colonies, after which sequences for antibody variable regions were analyzed. Among these, scFv-phages, selected by excluding clones with overlapping amino acid sequences, were cloned into a vector in the form of an scFv antibody fragment (scFv-Fc) in order to evaluate the expression capacity in the candidate antibody animal cell lines. After transfection and expression in CHO cells using a transfection reagent, the culture solution thereof was used, and the ability of the scFv-Fc antibody fragment to bind to two S proteins of SARS-CoV-2 was measured through ELISA. Briefly, SARS-CoV-2 S proteins were attached to the ELISA plate, and the expressed antibody fragments were added thereto. After washing the unbound antibody with PBS containing 0.05% Tween 20, antibody fragments bound to the antigen were selected and evaluated using an anti-human IgG antibody linked with HRP (horseradish peroxidase).

Based on the results thereof, as shown in Table 3 below, it was confirmed that a plurality of antibody fragments specifically bound to the S proteins of SARS-CoV-2, and the binding ability thereof is represented as a relative value compared to the positive control antibody. In Table 3 below, the positive control antibody (CR3022) is an antibody known to strongly bind to the SARS-CoV-2 S protein (Xiaolong Tian et al., Emerg. Microbes Infect. 2020 Feb. 17; 9(1):382-385). In Table 3 below, "No." refers to the same binding molecule as the No. of each binding molecule shown in Tables 1 and 2.

TABLE 3

| No. | Binding ability |
|---|---|
| 1 | 0.97 |
| 2 | 0.94 |
| 3 | 1.48 |
| 4 | 1.43 |
| 6 | 1.06 |
| 7 | 1.20 |
| 8 | 1.16 |
| 9 | 0.97 |
| 13 | 1.17 |

TABLE 3-continued

| No. | Binding ability |
|---|---|
| 14 | 0.89 |
| 31 | 1.35 |
| 44 | 0.95 |
| 46 | 1.60 |
| 47 | 1.67 |
| 48 | 1.17 |
| 49 | 0.87 |
| 53 | 1.04 |
| 55 | 0.98 |
| 56 | 1.23 |
| 65 | 1.32 |
| 66 | 1.75 |
| 69 | 1.44 |
| 70 | 1.34 |
| 71 | 1.20 |
| 72 | 0.65 |
| 79 | 1.16 |
| 81 | 1.63 |
| 83 | 1.14 |
| 86 | 1.41 |
| 88 | 1.59 |
| 89 | 1.37 |
| 90 | 1.47 |
| 91 | 1.29 |
| 93 | 2.86 |
| 95 | 2.29 |
| 103 | 1.13 |
| 108 | 1.82 |
| 113 | 1.44 |
| 118 | 1.36 |
| 128 | 1.40 |
| 129 | 1.42 |
| 139 | 1.36 |
| 152 | 1.18 |
| 195 | 0.14 |
| 196 | 1.94 |
| 197 | 2.09 |
| 201 | 2.08 |
| 203 | 1.06 |
| 204 | 1.15 |
| 205 | 1.23 |
| 206 | 1.03 |
| 207 | 1.26 |
| 208 | 2.51 |
| 209 | 1.43 |
| 212 | 1.56 |
| 213 | 1.70 |
| 214 | 1.19 |
| 215 | 1.12 |
| 216 | 0.97 |
| 217 | 1.47 |
| 218 | 1.13 |
| 219 | 1.29 |
| 220 | 1.66 |
| 221 | 1.23 |
| 224 | 0.79 |
| 230 | 1.03 |
| 232 | 1.01 |
| 235 | 1.25 |
| 236 | 1.50 |
| 239 | 1.45 |
| 241 | 1.39 |
| 242 | 1.47 |
| 243 | 1.54 |
| 244 | 1.42 |
| 245 | 1.28 |
| 246 | 1.31 |
| 247 | 1.31 |
| 249 | 0.34 |
| 250 | 0.90 |
| 251 | 0.92 |
| 252 | 0.94 |
| 254 | 1.26 |
| 256 | 0.47 |
| 259 | 1.14 |
| 260 | 0.81 |
| 261 | 0.92 |
| 263 | 1.46 |
| 265 | 0.97 |
| 266 | 0.80 |
| 268 | 1.09 |
| 270 | 0.95 |
| 271 | 0.79 |
| 274 | 1.01 |
| 275 | 0.85 |
| 276 | 1.00 |
| 278 | 0.70 |
| 279 | 0.57 |
| 280 | 1.32 |
| 281 | 1.36 |
| 283 | 0.38 |
| 284 | 1.08 |
| 285 | 1.25 |
| 287 | 0.80 |
| 288 | 0.27 |
| 289 | 1.08 |
| 290 | 0.75 |
| Positive control antibody | 1.00 |

Example 5: Evaluation of Neutralizing Activity of scFv-Fc Antibody Fragment Against SARS-CoV-2 Virus The 106 antibody fragments selected based on the ability to bind to the SARS-CoV-2 S protein in Example 4 were evaluated for efficacy against the Kore an isolate SARS-CoV-2 virus (BetaCoV/Korea/KCDC03/2020) using a PRNT (plaque reduction neutralization test) method.

For PRNT, antibody samples were diluted (1 ng/µℓ, 0.1 ng/µℓ), mixed with 0.025 MOI virus in equal amounts, allowed to react at 37° C. for 2 hours, used to infect a VERO.E6 cell line, and subjected to a plaque assay. After culture in a 5% $CO_2$ incubator at 37° C. for 60 hours and then staining using crystal violet, the number of plaques that formed was comparatively analyzed, and the neutralizing activity of the antibody samples was evaluated. The neutralizing activity (%) of the antibody was represented based on the neutralizing activity of 0% by measuring the number of plaques in the antibody-treated group and the control group (virus control). In Table 4 below, the greater the value shown, the better the neutralizing activity (%).

Based on the results of analysis, as shown in Table 4 below, antibody fragments having superior neutralizing activity were confirmed. In Table 4 below, "No." refers to the same binding molecule as the No. of each binding molecule shown in Tables 1 and 2.

TABLE 4

| | Dilution concentration of scFv-Fc antibody fragment | |
|---|---|---|
| No. | 1 ng/µℓ | 0.1 ng/µℓ |
| 1 | 96.2 | 19.2 |
| 2 | 69.2 | 42.3 |
| 3 | 76.9 | 3.8 |
| 4 | 76.9 | 50 |
| 6 | 57.7 | 7.7 |
| 7 | 69.2 | 42.3 |
| 8 | 38.5 | −11.5 |
| 9 | 50 | −11.5 |
| 13 | 69.2 | 46.2 |
| 14 | 96.2 | 42.3 |
| 31 | 50 | 34.6 |
| 44 | 26.9 | −15.4 |

TABLE 4-continued

| No. | Dilution concentration of scFv-Fc antibody fragment | |
|---|---|---|
| | 1 ng/μℓ | 0.1 ng/μℓ |
| 46 | 65.4 | 11.5 |
| 47 | 65.4 | 53.8 |
| 48 | 73.1 | 50 |
| 49 | 30.8 | −11.5 |
| 53 | 73.1 | 38.5 |
| 55 | 65.4 | 57.7 |
| 56 | 65.4 | 15.4 |
| 65 | 57.7 | −7.7 |
| 66 | 53.8 | 11.5 |
| 69 | 88.5 | 19.2 |
| 70 | 84.6 | 26.9 |
| 71 | 92.3 | 38.5 |
| 72 | 84.6 | 34.6 |
| 79 | 69.2 | 23.1 |
| 81 | 69.2 | 38.5 |
| 83 | 76.9 | 30.8 |
| 86 | 61.5 | 65.4 |
| 88 | 53.8 | 53.8 |
| 89 | 100 | 80.8 |
| 90 | 100 | 100 |
| 91 | 100 | 100 |
| 93 | 100 | 100 |
| 95 | 100 | 100 |
| 103 | 100 | 100 |
| 108 | 100 | 100 |
| 113 | 96.2 | 100 |
| 118 | 100 | 100 |
| 128 | 100 | 100 |
| 129 | 100 | 100 |
| 139 | 100 | 100 |
| 152 | 100 | 100 |
| 195 | 57.7 | 26.9 |
| 196 | 73.1 | 69.2 |
| 197 | 96.2 | 38.5 |
| 201 | 88.5 | 65.4 |
| 203 | 50 | 7.7 |
| 204 | 46.2 | −7.7 |
| 205 | 84.6 | 50 |
| 206 | 53.8 | −3.8 |
| 207 | 65.4 | 38.5 |
| 208 | 84.6 | 57.7 |
| 209 | 61.5 | −26.9 |
| 212 | 84.6 | 57.7 |
| 213 | 88.5 | 15.4 |
| 214 | 80.8 | 65.4 |
| 215 | 76.9 | 61.5 |
| 216 | 42.3 | 11.5 |
| 217 | 100 | 69.2 |
| 218 | 96.2 | 73.1 |
| 219 | 100 | 50 |
| 220 | 84.6 | 30.8 |
| 221 | 100 | 57.7 |
| 224 | 88.5 | −7.7 |
| 230 | 100 | 69.2 |
| 232 | 80.8 | 11.5 |
| 235 | 84.6 | 42.3 |
| 236 | 96.2 | 57.7 |
| 239 | 96.2 | 46.2 |
| 241 | 96.2 | 65.4 |
| 242 | 80.8 | 38.5 |
| 243 | 84.6 | 50 |
| 244 | 42.3 | 11.5 |
| 245 | 92.3 | 50 |
| 246 | 84.6 | 76.9 |
| 247 | 96.2 | 57.7 |
| 249 | 53.8 | 38.5 |
| 250 | 84.6 | 42.3 |
| 251 | −19.2 | 23.1 |
| 252 | 57.7 | 11.5 |
| 254 | 84.6 | 65.4 |
| 256 | 53.8 | 19.2 |
| 259 | 88.5 | 50 |
| 260 | 92.3 | 92.3 |
| 261 | 61.5 | 19.2 |
| 263 | 38.5 | 15.4 |
| 265 | 88.5 | 84.6 |
| 266 | 96.2 | 65.4 |
| 268 | 96.2 | 50 |
| 270 | 100 | 80.8 |
| 271 | 100 | 76.9 |
| 274 | 96.2 | 76.9 |
| 275 | 100 | 69.2 |
| 276 | 100 | 42.3 |
| 278 | 69.2 | 42.3 |
| 279 | 42.3 | 38.5 |
| 280 | 80.8 | 15.4 |
| 281 | 100 | 92.3 |
| 283 | 100 | 38.5 |
| 284 | 100 | 80.8 |
| 285 | 96.2 | 53.8 |
| 287 | 61.5 | 3.8 |
| 288 | 73.1 | 19.2 |
| 289 | 34.6 | 50 |
| 290 | 88.5 | 23.1 |

* The unit of the neutralizing activity value is %

Example 6: Evaluation of Antibody Expression Level and Antibody Binding Specificity after Conversion into Fully Human Antibody (Full IgG)

The selected antibody fragments were converted into fully human antibodies using the genetic information thereof, an antibody culture solution was prepared through the method of Example 4, and the antigen binding and antibody expression levels in the fully human antibodies were confirmed, and based on the results thereof in combination with the results of evaluation of virus-neutralizing activity, 23 fully human antibodies out of 106 were selected. The expression levels of the 23 fully human antibodies thus selected are shown in Table 5 below.

TABLE 5

| No. | μg/ml |
|---|---|
| 89 | 42.4 |
| 90 | 39.1 |
| 91 | 37.9 |
| 93 | 66.1 |
| 95 | 30.0 |
| 103 | 48.3 |
| 108 | 22.0 |
| 113 | 61.3 |
| 118 | 58.5 |
| 128 | 49.6 |
| 129 | 20.4 |
| 139 | 65.1 |
| 152 | 15.2 |
| 217 | 35.7 |
| 218 | 5.8 |
| 230 | 15.9 |
| 260 | 19.7 |
| 270 | 53.8 |
| 271 | 28.8 |
| 274 | 7.0 |
| 275 | 30.7 |
| 281 | 34.9 |
| 284 | 54.6 |

Example 7: Evaluation of Neutralizing Activity of Fully Human Antibody (Full IgG) (1)

The 23 fully human antibodies (full IgGs) selected based on the ability to bind to the SARS-CoV-2 S protein and the expression level in Example 6 were evaluated for efficacy against the Korean isolate SARS-CoV-2 virus (BetaCoV/Korea/KCDC03/2020) using a PRNT (plaque reduction neutralization test) method.

For PRNT, the antibody samples were diluted (10 concentrations, obtained through ¼ serial dilution from 1 ng/µℓ, and 11 concentrations, obtained through ½ serial dilution from 0.5 ng/µℓ, mixed with 0.05 MOI virus in equal amounts, allowed to react at 37° C. for 2 hours, used to infect a VERO.E6 cell line, and subjected to a plaque assay. After culture in a 5% $CO_2$ incubator at 37° C. for 60 hours and then staining using crystal violet, the number of plaques that formed was comparatively analyzed, and the neutralizing capacity of the antibody samples was evaluated. The neutralizing activity (ng/ml) of the antibody is an average value obtained from the results of evaluation of neutralizing activity performed two times, and was represented as the IC50 value of the antibody-treated group (the antibody concentration at which the antibody represents 50% of the neutralizing activity against the virus). In Table 6 below, the lower the value shown, the better the neutralizing activity.

Based on the results of analysis, as shown in Table 6 below, fully human antibodies (full IgGs) having superior neutralizing activity were confirmed. In Table 6 below, "No." refers to the same binding molecule as the No. of each binding molecule shown in Tables 1 and 2.

TABLE 6

| No. | IC50 (ng/ml) |
|---|---|
| 89 | 9.3 |
| 90 | 16.5 |
| 91 | 9.2 |
| 93 | 17.7 |
| 95 | 8.4 |
| 103 | 12.5 |
| 108 | 7.4 |
| 113 | 4.3 |
| 118 | 18.3 |
| 128 | 13.7 |
| 129 | 4.2 |
| 139 | 4.1 |
| 152 | 6.2 |
| 217 | 5950.0 |
| 218 | 562.0 |
| 230 | 432.0 |
| 260 | 400.5 |
| 270 | 151.6 |
| 271 | 1677.0 |
| 274 | 301.5 |
| 275 | 271.5 |
| 281 | 1429.0 |
| 284 | 701.5 |

Example 8: Evaluation of Neutralizing Activity of Fully Human Antibody (Full IgG) (2)

10 fully human antibodies (full IgGs) out of 23 fully human antibodies, selected based on the ability to bind to the SARS-CoV-2 S protein and the expression level in Example 7, were evaluated for neutralizing activity against the Korean isolate SARS-CoV-2 virus.

In the method of evaluation of neutralizing activity, the antibody samples were diluted (12 concentrations, obtained through 1/2 serial dilution from the antibody 10 µg/ml stock), mixed with 100 TCID50 (tissue culture infective dose 50) in equal amounts, allowed to react at 37° C. for 1 hour, and used to infect a VERO.E6 cell line. 1 TCID50 is a dose through which a virus can infect a cell, and 100 TCID50 is 100 times the virus concentration of 1 TCID50. The infected cell line was cultured in a 5% $CO_2$ incubator at 37° C. for 72 hours, and the cells were stained using crystal violet and analyzed to evaluate the neutralizing activity of the antibody samples.

As shown in Table 7 below, the result of analysis of neutralizing activity was represented as the lowest concentration value of each antibody for neutralizing the virus of 100 TCID50. The lowest concentration value of the antibody is an average value obtained from the results of evaluation of neutralizing activity performed three times. Here, the lower the value shown, the better the neutralizing activity. In Table 7 below, "No." refers to the same binding molecule as the No. of each binding molecule shown in Tables 1 and 2.

TABLE 7

| No. | Lowest concentration of antibody (µg/ml) |
|---|---|
| 91 | 2.1 |
| 93 | 2.5 |
| 103 | 1.7 |
| 217 | >10 |
| 270 | >10 |
| 284 | >10 |
| 129 | 3.3 |
| 139 | 3.3 |
| 260 | >10 |
| 275 | >10 |

Example 9: Evaluation of Neutralizing Activity of Fully Human Antibody (Full IgG) Against SARS-CoV-2 Virus 9-1. Evaluation of Neutralizing Activity of Fully Human Antibody (Full IgG)

6 fully human antibodies (full IgGs) out of 23 fully human antibodies, selected based on the ability to bind to the SARS-CoV-2 S protein and the expression level in Example 7, were evaluated for efficacy against the Korean isolate SARS-CoV-2 (BetaCoV/Korea/KCDC03/2020, 614D, S-type) and SARS-CoV-2 mutant virus (hCoV-19/South Korea/KUMC17/2020, 614G, G-type) using a PRNT (plaque reduction neutralization test) method.

For PRNT, the antibody samples were diluted (11 concentrations, obtained through 1/4 serial dilution from 1 ng/µℓ), mixed with 0.05 MOI virus in equal amounts, allowed to react at 37° C. for 2 hours, used to infect a VERO.E6 cell line, and subjected to a plaque assay. After culture in a 5% $CO_2$ incubator at 37° C. for 60 hours and then staining using crystal violet, the number of plaques that formed was comparatively analyzed, and the neutralizing capacity of the antibody samples was evaluated. The neutralizing activity (ng/ml) of the antibody is an average value obtained from the results of evaluation of neutralizing activity performed two times, and was represented as the IC50 value of the antibody-treated group (the antibody concentration at which the antibody represents 50% of the neutralizing activity against the virus). In Tables 8 and 9 below, the lower the IC50 value, the better the neutralizing activity.

Based on the results of analysis, as shown in Table 8 and Table 9 below, high neutralizing activity against the Korean isolate SARS-CoV-2 (BetaCoV/Korea/KCDC03/2020, 614D, S-type) and the SARS-CoV-2 mutant virus (hCoV-19/South Korea/KUMC17/2020, 614G, G-type) was confirmed. In Tables 8 and 9 below, "No." refers to the same binding molecule as the No. of each binding molecule shown in Tables 1 and 2.

TABLE 8

| No. | IC50 (ng/ml) |
|---|---|
| 91 | 31.05 |
| 93 | 122.8 |
| 103 | 53.21 |
| 129 | 27.53 |
| 139 | 29.83 |
| 260 | >1000 |

TABLE 9

| No. | IC50 (ng/ml) |
|---|---|
| 91 | 6.08 |
| 93 | 6.81 |
| 103 | 2.69 |
| 129 | 1.27 |
| 139 | 3.37 |
| 260 | >1000 |

9-2. Evaluation of Neutralizing Activity of No. 139 Antibody (1)

The No. 139 antibody, selected based on antibody characteristics such as antibody expression level and the like, was further evaluated for efficacy against the Korean isolate SARS-CoV-2 (BetaCoV/Korea/KCDC03/2020, 614D, S-type) and the SARS-CoV-2 mutant virus (hCoV-19/South Korea/KUMC17/2020, 614G, G-type) using a PRNT (plaque reduction neutralization test)method as described above.

Based on the results of analysis, the neutralizing activity of IC50 (8.37 ng/ml) against the Korean isolate SARS-CoV-2 (BetaCoV/Korea/KCDC03/2020, 614D, S-type) and the neutralizing activity of IC50 (5.73 ng/ml) against the mutant virus (hCoV-19/South Korea/KUMC17/2020, 614G, G-type) were confirmed again (FIG. 1).

9-3. Evaluation of Neutralizing Activity of No. 139 Antibody (2)

The No. 139 antibody, selected based on antibody characteristics such as antibody expression level and the like, was further evaluated for efficacy against the Korean isolate SARS-CoV-2 (BetaCoV/Korea/KCDC03/2020, 614D, S-type), SARS-CoV-2 mutant virus (hCoV-19/South Korea/KCDC9481/2020, 614G, G-type), GR-type (hCoV-19/South Korea/KUMC17/2020), GH-type (hCoV-19/Korea/KCDC10847/2020), V-type (hCoV-19/Korea/KCDC31/2020), and L-type (hCoV-19/South Korea/KNIH04/2020) using a PRNT (plaque reduction neutralization test) method as described above.

Based on the results of analysis, the neutralizing activity against all six types of SARS-CoV-2 viruses (S, G, GR, GH, V, and L types) was confirmed as shown in Table 10 below.

TABLE 10

| Type | IC50 (ng/ml) |
|---|---|
| S | 6.76 |
| G | 10.62 |
| GR | 5.77 |
| GH | 10.36 |
| V | 8.00 |
| L | 4.79 |

9-4. Evaluation of Neutralizing Activity of No. 139 Antibody (3)

The No. 139 antibody, selected based on antibody characteristics such as antibody expression level and the like, was further evaluated for efficacy against the Korean isolate GR-type (hCoV-19/South Korea/KUMC17/2020) and GH-type (hCoV-19/Korea/KCDC10847/2020) as control groups and British mutant virus strain (hCoV-19/South Korea/KDCA0838/2020) using a PRNT (plaque reduction neutralization test) method as described above.

Based on the results of analysis, the neutralizing activity against the British mutant virus strain was confirmed as shown in Table 11 below.

TABLE 11

| Type | IC50 (ng/ml) |
|---|---|
| GR | 4.22 |
| GH | 9.31 |
| British mutant | 9.62 |

Example 10: Evaluation of Presence or Absence of ADE (Antibody-Dependent Enhancement) by No. 139 Antibody (Full IgG)

Antibody-dependent enhancement (ADE) is well known in dengue virus, and is a phenomenon by which an immune cell is infected by a non-neutralizing antibody, thereby exacerbating a disease. Specifically, ADE refers to a phenomenon by which the antibody binds to the virus and the virus bound to the antibody infects the immune cell through the interaction of the Fc of the antibody and the Fc receptor of the immune cell. In some of the literature, it is reported that the serum of SARS patients did not neutralize the virus, but rather increased the viral infection of immune cells (Journal of Virology 85: 10582).

In order to evaluate the presence or absence of ADE by the No. 139 antibody, the neutralizing activity of the No. 139 antibody against SARS-CoV-2 (BetaCoV/Korea/KCDC03/2020) not only in VeroE6 (ACE2-expressing cell line) but also in Raji (FcγR 11-expressing immune cell line) and U937 (FcγR I & 11-expressing immune cell line) was evaluated through ELISA-based in-vitro infection assay.

For the in-vitro ADE assay, CT-P27 (influenza A-neutralizing antibody), CR3022 (SARS-neutralizing antibody, which binds to the spike protein of SARS-CoV-2 but has no neutralizing effect, Xiaolong Tian et al., Emerg Microbes Infect. 2020 Feb. 17; 9(1):382-385), and the No. 139 antibody sample were diluted (8 concentrations, obtained through 1/10 serial dilution from 1 μg/ml), mixed with 0.05 MOI virus, allowed to react at 37° C. for 2 hours, and used to infect VERO.E6, Raji, and U937 cell lines. After culture in a 5% $CO_2$ incubator at 37° C. for 24 hours, the cells were immobilized with 80% acetone. The amount of the virus that infected the cells (virus titer) was detected through ELISA. Specifically, a mouse anti-nucleocapsid antibody was allowed to react for 1 hour at room temperature, followed by treatment with anti-mouse IgG-HRP at room temperature for 1 hour. A color development reaction was performed with TMB for 5 minutes, the reaction was stopped by the addition of $H_2SO_4$, and optical density (OD) was measured at 450 nm. The neutralizing activity of the antibody in each of the VERO.E6, Raji and U937 cell lines is shown in FIGS. 2a, 2b and 2c, respectively, using the average value and standard deviation obtained from evaluation results repeated three or more times.

Figure 2A:
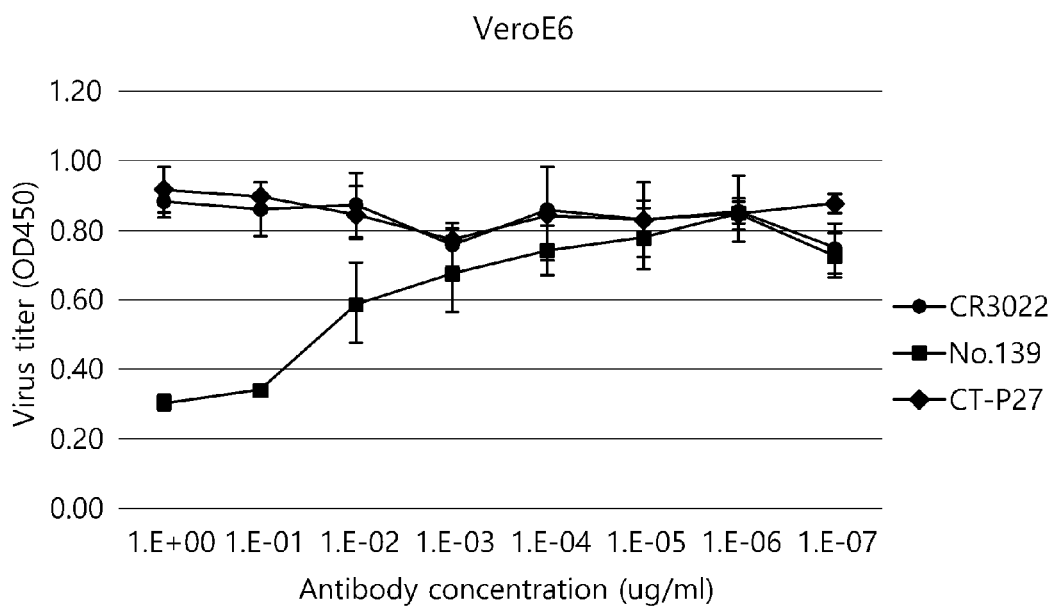
FIG. 2a shows the results of evaluation of neutralizing activity of the binding molecule of the present invention against SARS-CoV-2 in a VeroE6 cell line (an ACE2-expressing cell line) through ELISA-based in-vitro infection assay in order to evaluate the presence or absence of antibody-dependent enhancement (ADE) by the binding molecule of the present invention.
Figure 2B:
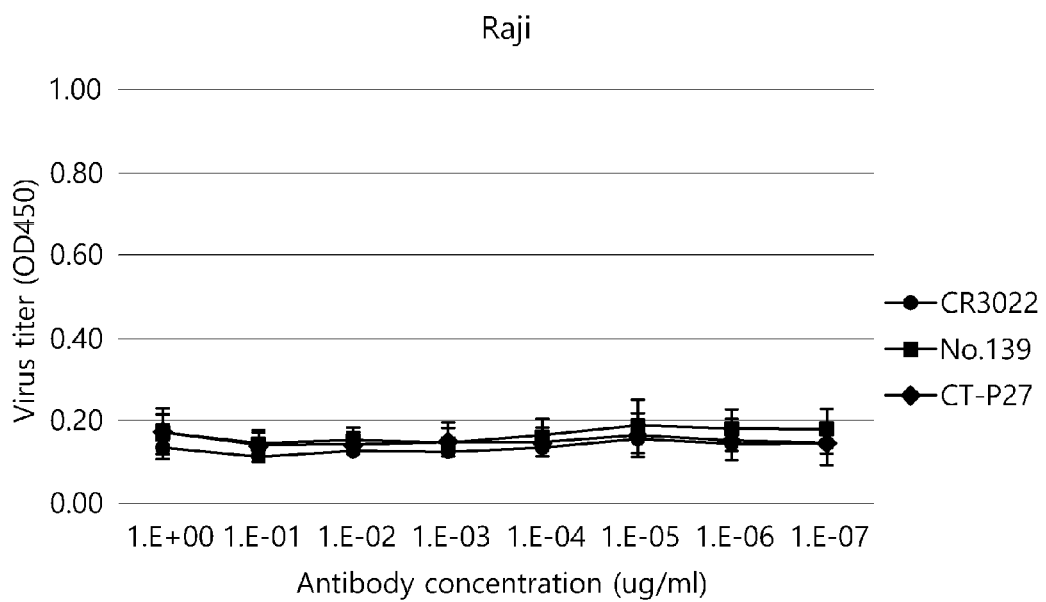
FIG. 2b shows the results of evaluation of neutralizing activity of the binding molecule of the present invention against SARS-CoV-2 in a Raji cell line (an FcγR 1-expressing immune cell line) through ELISA-based in-vitro infection assay in order to evaluate the presence or absence of ADE by the binding molecule of the present invention.
Figure 2C:
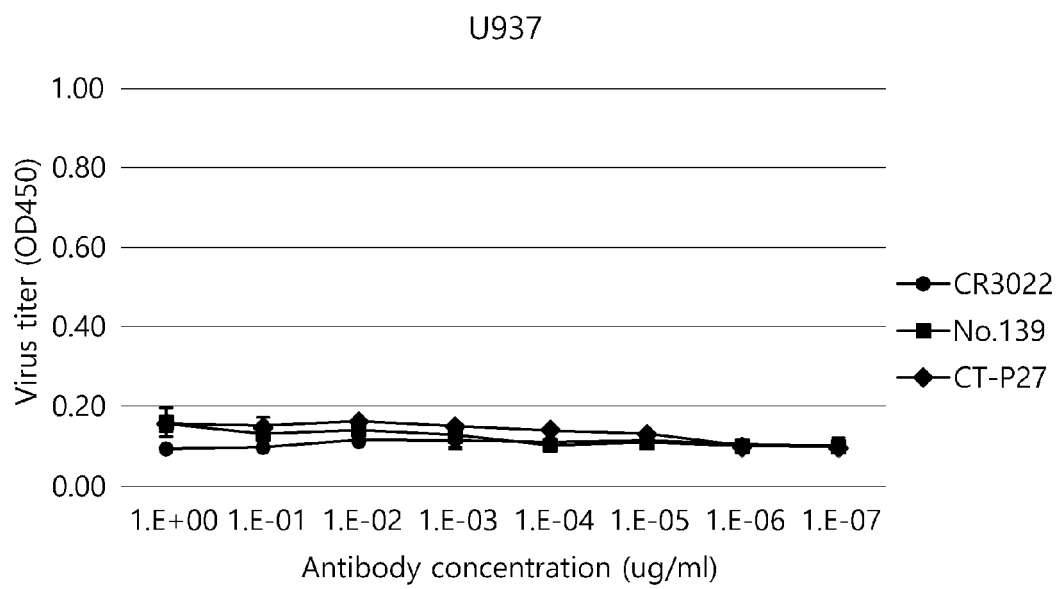
FIG. 2c shows the results of evaluation of neutralizing activity of the binding molecule of the present invention against SARS-CoV-2 in a U937 cell line (an FcγR I & 1-expressing immune cell line) through ELISA-based in-vitro infection assay in order to evaluate the presence or absence of ADE by the binding molecule of the present invention.

Based on the results of in-vitro ADE analysis, as shown in FIGS. 2a, 2b and 2c, the No. 139 antibody exhibited neutralizing activity against SARS-CoV-2 (BetaCoV/Korea/KCDC03/2020) in VeroE6 cells, whereas CT-P27 and CR3022 did not exhibit neutralizing activity. Also, the No. 139 antibody did not increase viral infection at any concentration. At all concentrations evaluated in Raji and U937 cells containing Fcγ receptors, an increase in viral infection due to CT-P27, CR3022, and No. 139 antibodies was not observed. Moreover, there was not observed a viral infection enhancement phenomenon, that is, an ADE phenomenon, due to the interaction between the Fc of the No. 139 antibody and the Fcγ receptor of the immune cell, against SARS-CoV-2 (FIGS. 2a, 2b and 2c).

order to evaluate the virus titer in the tissue, two ferrets per group on the $3^{rd}$ day and three ferrets per group on the $7^{th}$ day were sacrificed to obtain turbinate and lung tissues, and the virus titers thereof were measured in the same manner.

Based on the results thereof, as shown in Table 12 below, cough, rhinorrhea, and decreased activity in clinical symptoms began to be observed from the $2^{nd}$ day after infection in all groups. The control group showed the most severe clinical symptoms on the $3^{rd}$ and 4 days after infection, and showed rhinorrhea and decreased activity until the end of the test, whereas, in the No. 139 antibody low-dose and high-dose administration groups, mild clinical symptoms (rhinorrhea, decreased activity) were observed compared to the control group on the $2^{nd}$ day after infection, and clinical symptoms were not observed and were eliminated on the $6^{th}$ day (Table 12 below).

TABLE 12

| Group | Clinical symptoms[1] | Viral challenge | Drug treatment | Day post Treatment 1 | Day post Treatment 2 | Day post Treatment 3 | Day post Treatment 4 | Day post Treatment 5 |
|---|---|---|---|---|---|---|---|---|
| Control | Cough[2] | 0.00 | 0.00 | 0.40 | 1.00 | 1.00 | 0.00 | 0.00 |
|  | Rhinorrhea[3] | 0.00 | 0.00 | 1.00 | 1.00 | 1.00 | 1.00 | 1.00 |
|  | Movement, activity[4] | 0.00 | 0.00 | 1.40 | 2.00 | 2.00 | 1.33 | 1.00 |
|  | Total | 0.00 | 0.00 | 2.80 | 4.00 | 4.00 | 2.33 | 2.00 |
| CT-P59 (low dose) | Cough[2] | 0.00 | 0.00 | 0.00 | 0.00 | 0.00 | 0.00 | 0.00 |
|  | Rhinorrhea[3] | 0.00 | 0.00 | 0.60 | 1.00 | 1.00 | 0.00 | 0.00 |
|  | Movement, activity[4] | 0.00 | 0.00 | 1.00 | 1.00 | 0.67 | 0.67 | 0.00 |
|  | Total | 0.00 | 0.00 | 1.60 | 2.00 | 1.67 | 0.67 | 0.00 |
| CT-P59 (high dose) | Cough[2] | 0.00 | 0.00 | 0.00 | 0.00 | 0.00 | 0.00 | 0.00 |
|  | Rhinorrhea[3] | 0.00 | 0.00 | 0.60 | 1.00 | 1.00 | 0.00 | 0.00 |
|  | Movement, activity[4] | 0.00 | 0.00 | 1.00 | 1.00 | 0.67 | 0.67 | 0.00 |
|  | Total | 0.00 | 0.00 | 1.60 | 2.00 | 1.67 | 0.67 | 0.00 |

[1] Observational clinical symptoms: Cough, rhinorrhea, movement activity.
Scores were measured by clinical observation symptoms at least 20 minutes in each group of ferrets on the basis of the following criteria:
[2] Cough; 0; no evidence of cough, 1; occasional cough, 2; frequent cough.
[3] Rhinorrhea: 0; no nasal rattling or sneezing, 1; moderate nasal discharge on external nares, 2; severe nasal discharge on external nares.
[4] Movement, activity: 0; normal movement and activity, 1; mild reduced movement and activity, 2; evidence of reduced movement and activity.

Example 11: Evaluation of Neutralizing Activity of No. 139 Antibody (Full IgG) Against SARS-CoV-2 Virus Through Animal Experiment 11-1. Experiment of Evaluation of Neutralizing Activity in Ferret Using ferrets as an animal model that is naturally infected with SARS-CoV-2 and shows clinical symptoms and lesions similar to humans, in order to evaluate the in-vivo neutralizing activity of the No. 139 antibody, an experiment was conducted as follows.

Figure 3A:
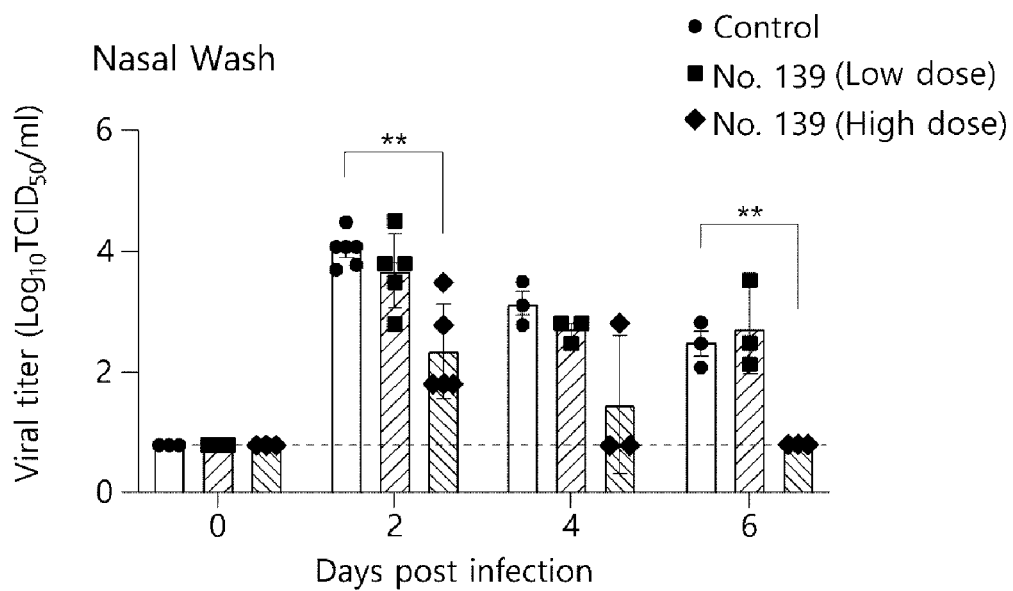
FIG. 3a shows the results of measurement of the virus titer in nasal lavage samples obtained from ferrets using Vero cells after viral inoculation with SARS-CoV-2 during the ferret animal experiment using the binding molecule of the present invention.

Ferrets were divided into a total of 3 groups of 5 ferrets per group, including a control group and treatment groups (No. 139 antibody low-dose and high-dose administration groups). 0.5 ml of $1 \times 10^{5.5}$ TCID$_{50}$/ml SARS-CoV-2 virus (NMC-nCoV02) was inoculated in each of the nasal cavity and the bronchi. One day after viral inoculation, 30 mg/kg of a control anti-IgE antibody regardless of SARS-CoV-2 virus or 3 mg/kg or 30 mg/kg of the No. 139 antibody was injected intravenously once, and the results thereof were observed for 7 days. Clinical symptoms of individuals in each group were evaluated daily for 7 days before and after viral infection. On the $2^{nd}$, $4^{th}$, and $6^{th}$ days after viral infection, the nasal lavage, saliva, and rectal swab samples were collected from ferrets of each group, and virus titers were measured using Vero cells and qRT-PCR. Moreover, in In addition, based on the results of measurement of the virus titer in nasal lavage samples obtained from ferrets using Vero cells, as shown in FIG. 3a, the virus titer was significantly decreased in the No. 139 antibody high-dose administration group on the $2^{nd}$ day after infection compared to the control group, and no virus was observed on the $6^{th}$ day (FIG. 3a).

Figure 3B:
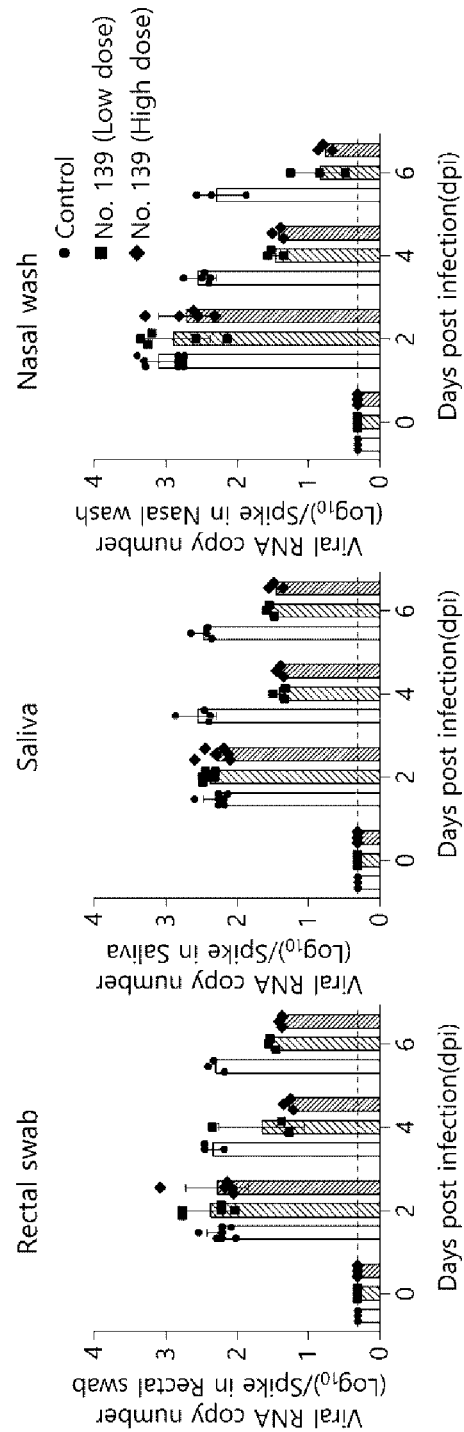
FIG. 3b shows the results of measurement of the virus titer in nasal lavage, saliva and rectal swab samples obtained from ferrets using qRT-PCR after viral inoculation with SARS-CoV-2 during the ferret animal experiment using the binding molecule of the present invention.

Based on the results of measurement of virus titers in nasal lavage, saliva and rectal swab samples obtained from ferrets using qRT-PCR, as shown in FIG. 3b, virus titers similar to those of the control group on the $2^{nd}$ day after infection were observed, but the virus titers were decreased in the No. 139 antibody low-dose and high-dose administration groups on the $4^{th}$ and $6^{th}$ days (FIG. 3b).

Figure 3C:
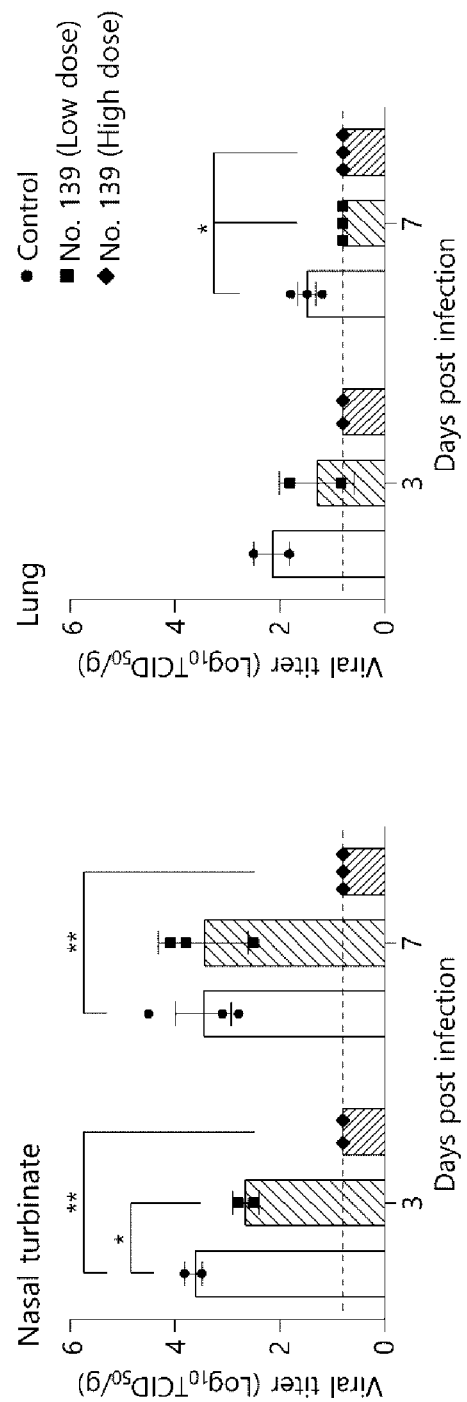
FIG. 3c shows the results of measurement of the virus titer in the turbinate tissue and lung tissue of ferrets using Vero cells after viral inoculation with SARS-CoV-2 during the ferret animal experiment using the binding molecule of the present invention.

Based on the results of measurement of the virus titer in the turbinate tissue of ferrets using Vero cells, as shown in FIG. 3c, the virus titer was decreased on the $3^{rd}$ day after infection in the No. 139 antibody low-dose administration group compared to the control group, and the virus titer was not observed on the $3^{rd}$ and $7^{th}$ days after infection in the No. 139 antibody high-dose administration group. Based on the results of measurement of the virus titer in the lung tissue in the same manner, the virus titer was not observed on the $7^{th}$ day after infection in the No. 139 antibody low-dose administration group and on the $3^{rd}$ and $7^{th}$ days after infection in the No. 139 antibody high-dose administration group (FIG. 3c).

Figure 3D:
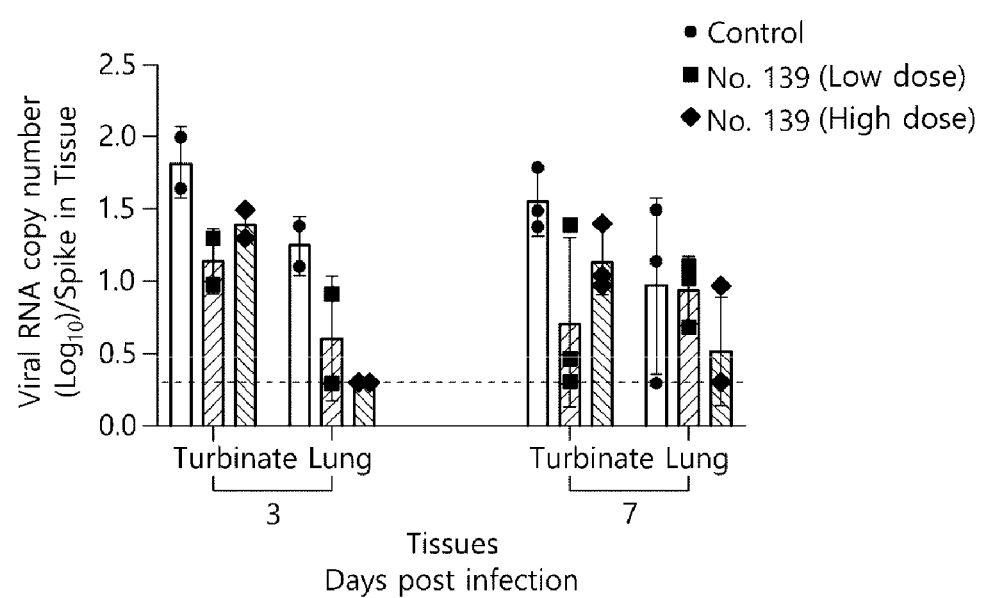
FIG. 3d shows the results of measurement of the virus titer in the turbinate tissue and lung tissue of ferrets using qRT-PCR after viral inoculation with SARS-CoV-2 during the ferret animal experiment using the binding molecule of the present invention.

Based on the results of measurement of the virus titer in the turbinate tissue of ferrets using qRT-PCR, as shown in FIG. 3d, the virus titer was decreased on the $3^{rd}$ and $7^{th}$ days after infection in the No. 139 antibody low-dose and high-dose administration groups compared to the control group. Based on the results of measurement of the virus titer in the lung tissue in the same manner, the virus titer was decreased on the $3^{rd}$ day after infection in the No. 139 antibody low-dose administration group and on the $3^{rd}$ and $7^{th}$ days after infection in the No. 139 antibody high-dose administration group (FIG. 3d).

On the $3^{rd}$ and $7^{th}$ days of infection, the lung tissue after autopsy was observed using a microscope. Based on the results of pathological analysis in the lung tissue of ferrets on the $3^{rd}$ day after viral infection, inflammation was observed as an increase in neutrophil cells and an increase in alveolar wall thickness throughout the lung tissue in the infection control group. Even in the No. 139 antibody low-dose administration group, less inflammation was observed than in the infection control group, and in the No. 139 antibody high-dose administration group, inflammation was notably reduced compared to the infection control group.

Figure 4:
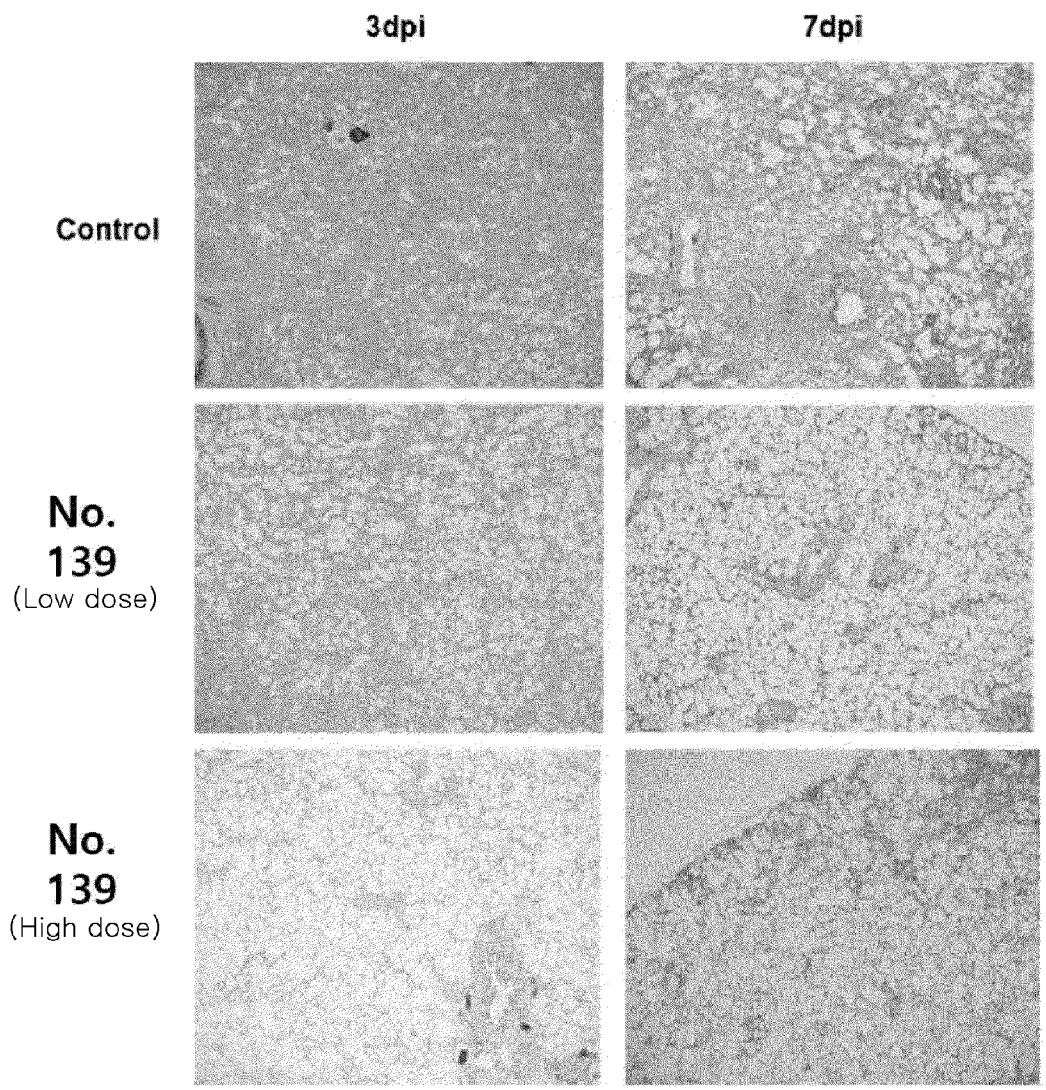
FIG. 4 is microscope images showing the lung tissue of ferrets after autopsy on the $3^{rd}$ and $7^{th}$ days of SARS-CoV-2 virus infection in the ferret animal experiment using the binding molecule of the present invention.

Based on the results of pathological analysis in the lung tissue of ferrets on the $7^{th}$ day after infection, in the infection control group, inflammation, observed as an increase in neutrophil cells and an increase in alveolar wall thickness, was decreased compared to the $3^{rd}$ day after infection but was generally maintained. In the No. 139 antibody low-dose and high-dose administration groups, inflammation was notably decreased compared to the infection control group, and inflammation was observed only in local areas (FIG. 4).

11-2. Experiment of Evaluation of Neutralizing Activity in Golden Syrian Hamster Using Golden Syrian hamsters as an animal model that is naturally infected with SARS-CoV-2 and shows clinical symptoms and lesions similar to humans, in order to evaluate the in-vivo neutralizing activity of the No. 139 antibody, an experiment was conducted as follows.

The hamsters were divided into a total of five groups of 12 hamsters per group, including a control group and treatment groups (15 mg/kg, 30 mg/kg, 60 mg/kg, and 90 mg/kg of No. 139 antibody), and $6.4 \times 10^4$ PFU/80 $\mu\ell$ of SARS-CoV-2 virus (NMC-nCoV02) was inoculated into the nasal cavity. One day after viral inoculation, a PBS control group regardless of SARS-CoV-2 or 15 mg/kg, 30 mg/kg, 60 mg/kg or 90 mg/kg of the No. 139 antibody was injected intraperitoneally once, and the results thereof were observed for 6 days. Additionally, the body weight of individuals in each group was evaluated daily for 6 days before and after viral infection. In order to measure the virus titer in the tissue, four hamsters per group were sacrificed on the $2^{nd}$, $3^{rd}$, and $5^{th}$ days after viral inoculation to obtain lung, turbinate, and duodenal tissues, the virus titer was measured in the lung, turbinate, and duodenum using qRT-PCR, and the live virus titer of the lung tissue was measured using Vero cells.

Figure 5A:
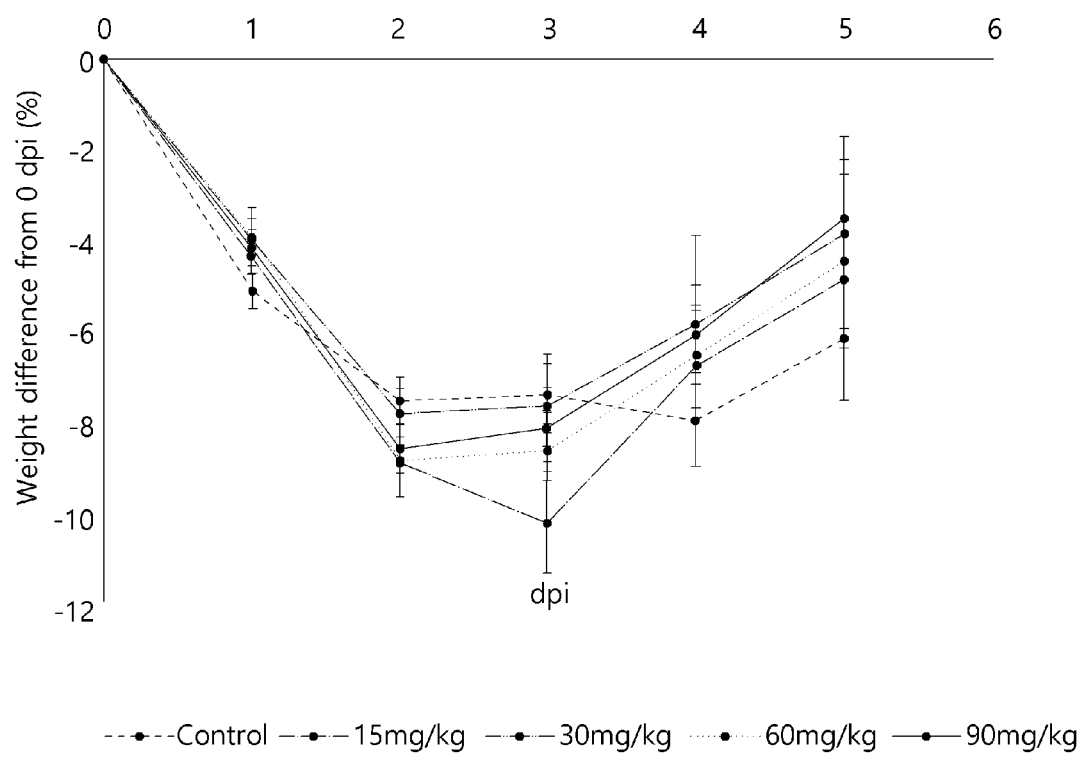
FIG. 5a shows the results of evaluation of the body weight of individuals in each group every day for 6 days before and after viral infection with SARS-CoV-2 during the Golden Syrian hamster animal experiment using the binding molecule of the present invention.
Figure 5B:
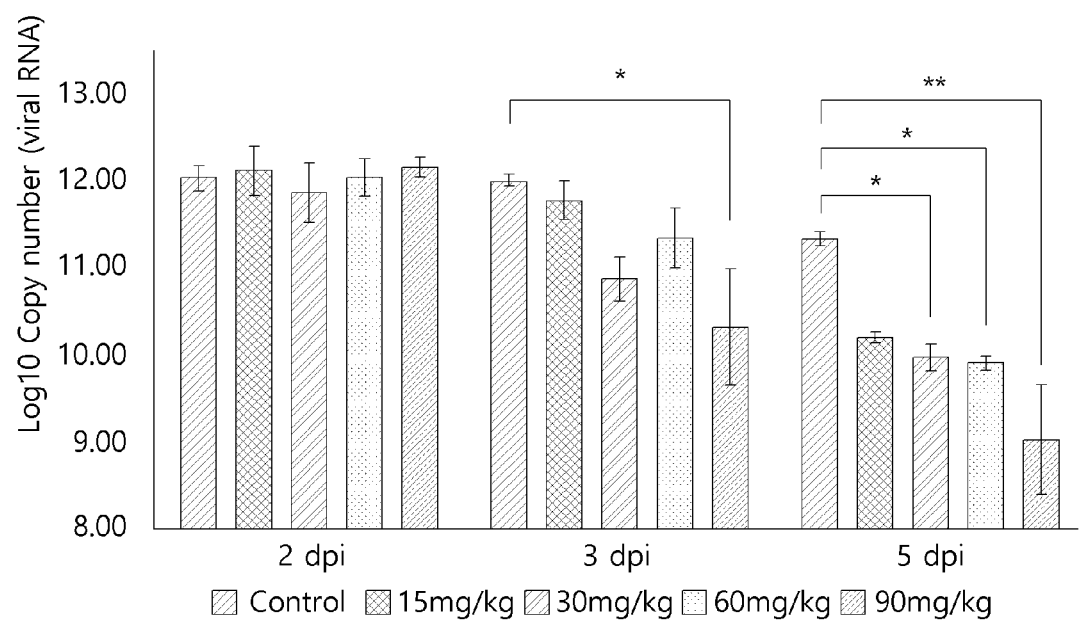
FIG. 5b shows the results of measurement of the virus titer of the lung of Golden Syrian hamsters using qRT-PCR after viral inoculation with SARS-CoV-2 during the Golden Syrian hamster animal experiment using the binding molecule of the present invention.
Figure 5C:
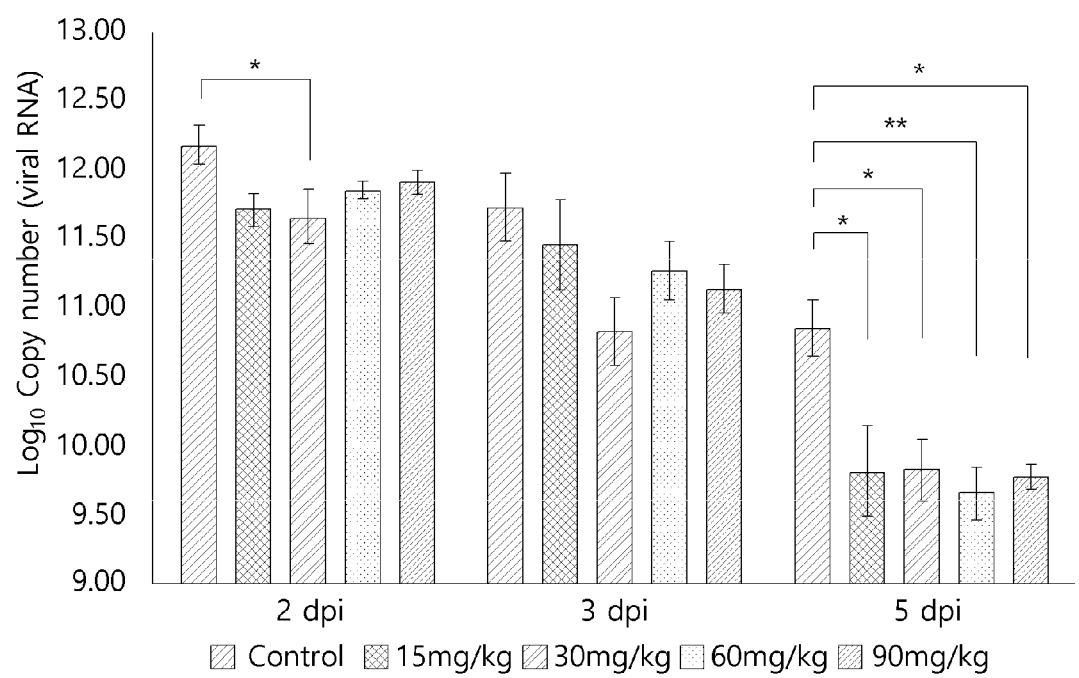
FIG. 5c shows the results of measurement of the virus titer of the turbinate of Golden Syrian hamsters using qRT-PCR after viral inoculation with SARS-CoV-2 during the Golden Syrian Hamster animal experiment using the binding molecule of the present invention.
Figure 5D:
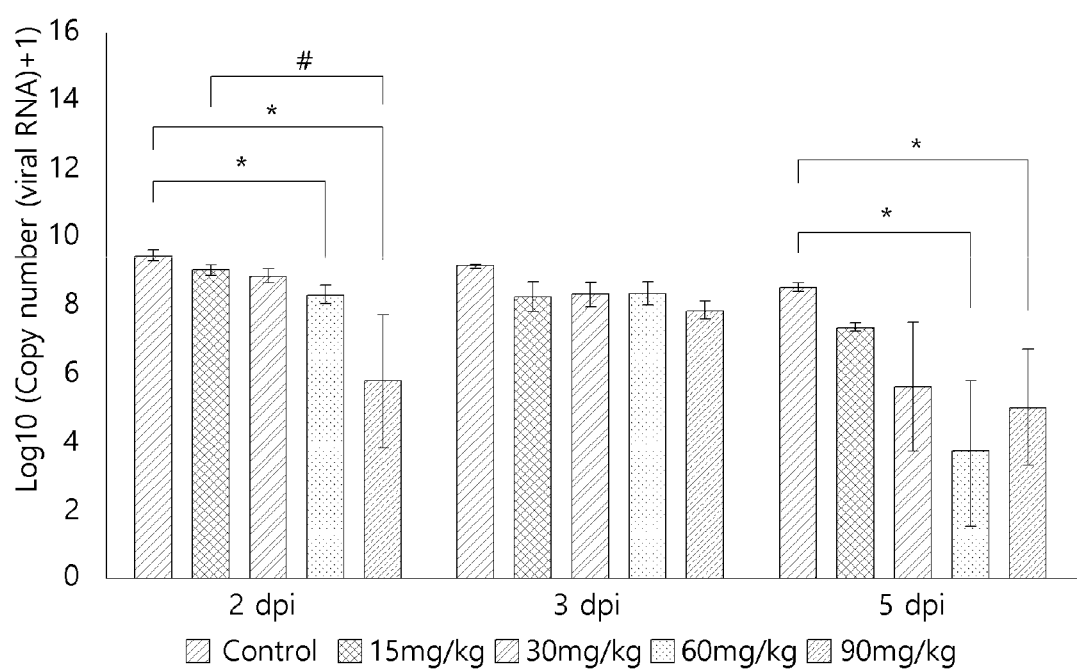
FIG. 5d shows the results of measurement of the virus titer of the duodenum of Golden Syrian hamsters using qRT-PCR after viral inoculation with SARS-CoV-2 during the Golden Syrian hamster animal experiment using the binding molecule of the present invention.

Based on the results thereof, as shown in FIG. 5a, there was no significant difference between groups in weight loss due to viral infection (FIG. 5a). In addition, the results of measurement of the virus titer in the lung, turbinate, and duodenum using qRT-PCR are as follows. When 90 mg/kg was administered to the lung, the post-test result on the $3^{rd}$ day after inoculation showed a decrease of about 47 times compared to the control group, and the post-test result on the $5^{th}$ day after inoculation showed decreases of 22 times, 27 times and 197 times upon administration of 30, 60 and 90 mg/kg, respectively, compared to the control group (FIG. 5b). The post-test result on the $2^{nd}$ day after inoculation in the turbinate showed a decrease of about 3 times upon administration of 30 mg/kg compared to the control group, and the post-test result on the $5^{th}$ day after inoculation showed decreases of 11 times, 11 times, 16 times and 12 times upon administration of 15, 30, 60 and 90 mg/kg, respectively, compared to the control group (FIG. 5c). The post-test result on the $2^{nd}$ day after inoculation in the duodenum showed that there was a statistically significant difference upon administration of 60 and 90 mg/kg compared to the control group, and the post-test result on the $5^{th}$ day after inoculation showed that there was a statistically significant difference upon administration of 60 and 90 mg/kg compared to the control group (FIG. 5d).

Figure 5E:
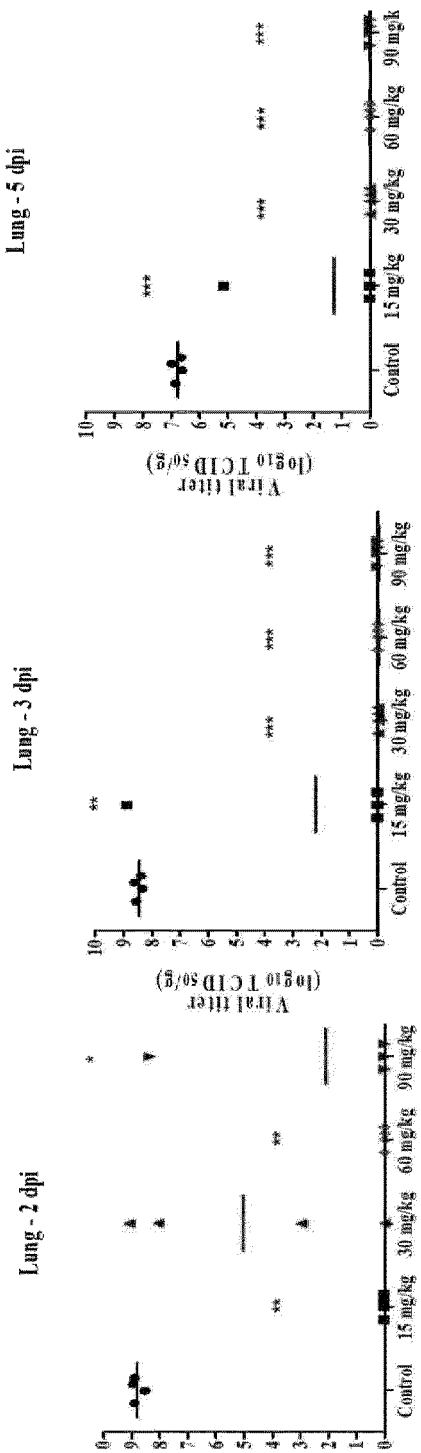
FIG. 5e shows the results of measurement of the virus titer of the lung tissue of Golden Syrian hamsters using Vero cells after viral inoculation with SARS-CoV-2 during the Golden Syrian hamster animal experiment using the binding molecule of the present invention.

In addition, based on the results of measurement of the live virus titer in the lung tissue using Vero cells, as shown in FIG. 5e, the virus titer was not observed from the $2^{nd}$ day after infection in the 60 and 90 mg/kg administration groups, except for one animal in the No. 139 antibody 90 mg/kg administration group, unlike the control group. In the 15 mg/kg administration group, a virus titer was not observed on the $2^{nd}$ day, but the virus titer was observed in one animal on the $3^{rd}$ and $5^{th}$ days. In the 30 mg/kg administration group, the virus titer was not observed from the 3 day (FIG. 5e).

11-3. Experiment of Evaluation of Prevention Ability in Mouse

Using TG mice (B6.Cg-Tg(K18-ACE2)2Prlmn/J [Stock No: 034860 | K18-hACE2] from The Jackson Laboratory) as an animal model that is naturally infected with SARS-CoV-2 and shows clinical symptoms and lesions similar to humans, in order to evaluate the in-vivo prevention ability of the No. 139 antibody, an experiment was conducted as follows.

The mice were divided into a total of 4 groups of five or six mice per group, including a control group and administration groups (10 mg/kg, 1 mg/kg and 0.1 mg/kg of the No. 139 antibody). 24 hours after administration with PBS or 0.1 mg/kg, 1 mg/kg or 10 mg/kg of the No. 139 antibody, $1 \times 10^5$ PFU 60 $\mu\ell$ of SARS-CoV-2 virus (NMC-nCoV02) was inoculated into the nasal cavity, and the results thereof were observed for a maximum of 6 days. Additionally, the body weight of individuals in each group was evaluated daily for 6 days before and after viral inoculation. In order to measure the virus titer in the tissue, the mice were sacrificed on the $3^{rd}$ and $6^{th}$ days after viral inoculation to obtain the lung tissue and nasal lavage, and the virus titer of each tissue was measured through plaque assay using Vero cells.

Based on the results thereof, in the control group, 2 individuals died on the $2^{nd}$ day after viral inoculation, 1 individual died on the $6^{th}$ day, and 1 individual died on the $2^{nd}$ day in each of the 0.1 mg/kg and 1 mg/kg administration groups. Early death (on the $2^{nd}$ day after inoculation) was suspected to be caused by encephalitis due to the expression of hACE2 protein in the CNS.

Figure 6A:
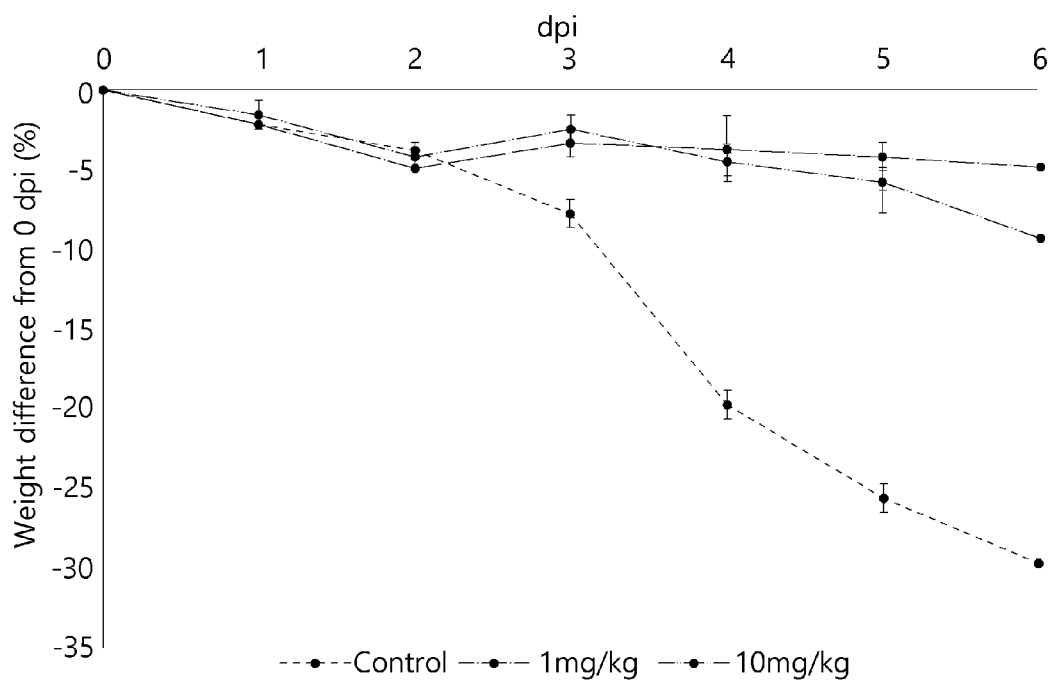
FIG. 6a shows the results of evaluation of the body weight of individuals in each group every day for 6 days before and after viral infection with SARS-CoV-2 during the mouse animal experiment using the binding molecule of the present invention.

Weight loss due to viral infection was greatly reduced in the 1 mg/kg and 10 mg/kg administration groups (FIG. 6a).

Figure 6B:
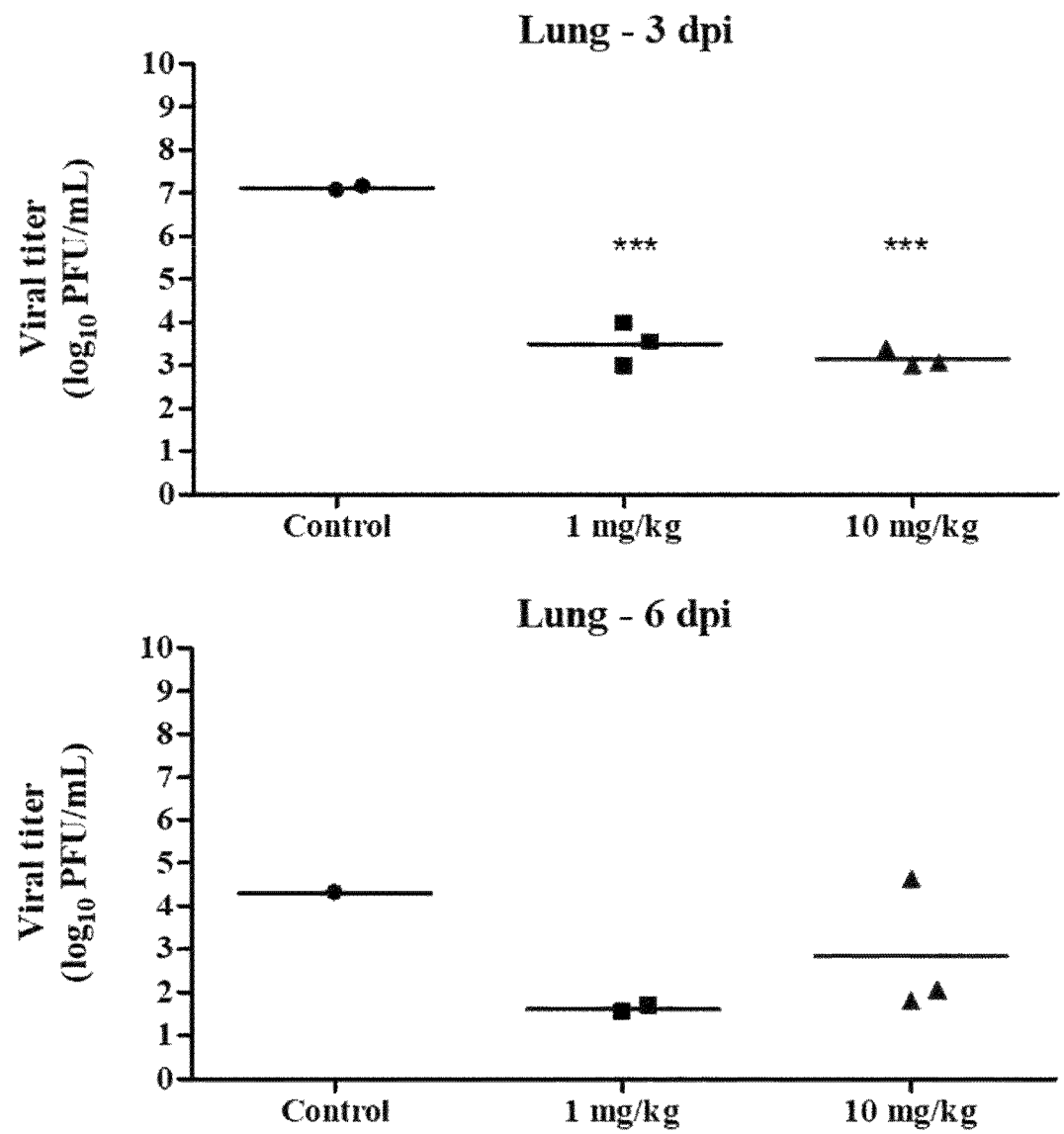
FIG. 6b shows the results of measurement of the virus titer of the lung tissue of mice using Vero cells after viral inoculation with SARS-CoV-2 during the mouse animal experiment using the binding molecule of the present invention.

In addition, the virus titers of the lung and nasal lavage, measured by a plaque assay, were as follows. Upon administration of 0.1, 1, and 10 mg/kg, the virus titers of the lungs were decreased 9 times, 4,079 times, and 9,007 times, respectively, compared to the control group on the $3^{rd}$ day after inoculation. In addition, the virus titers of the lungs were decreased 25 times, 478 times, and 29 times, respectively, compared to the control group on the $6^{th}$ day after inoculation (FIG. 6b).

Figure 6C:
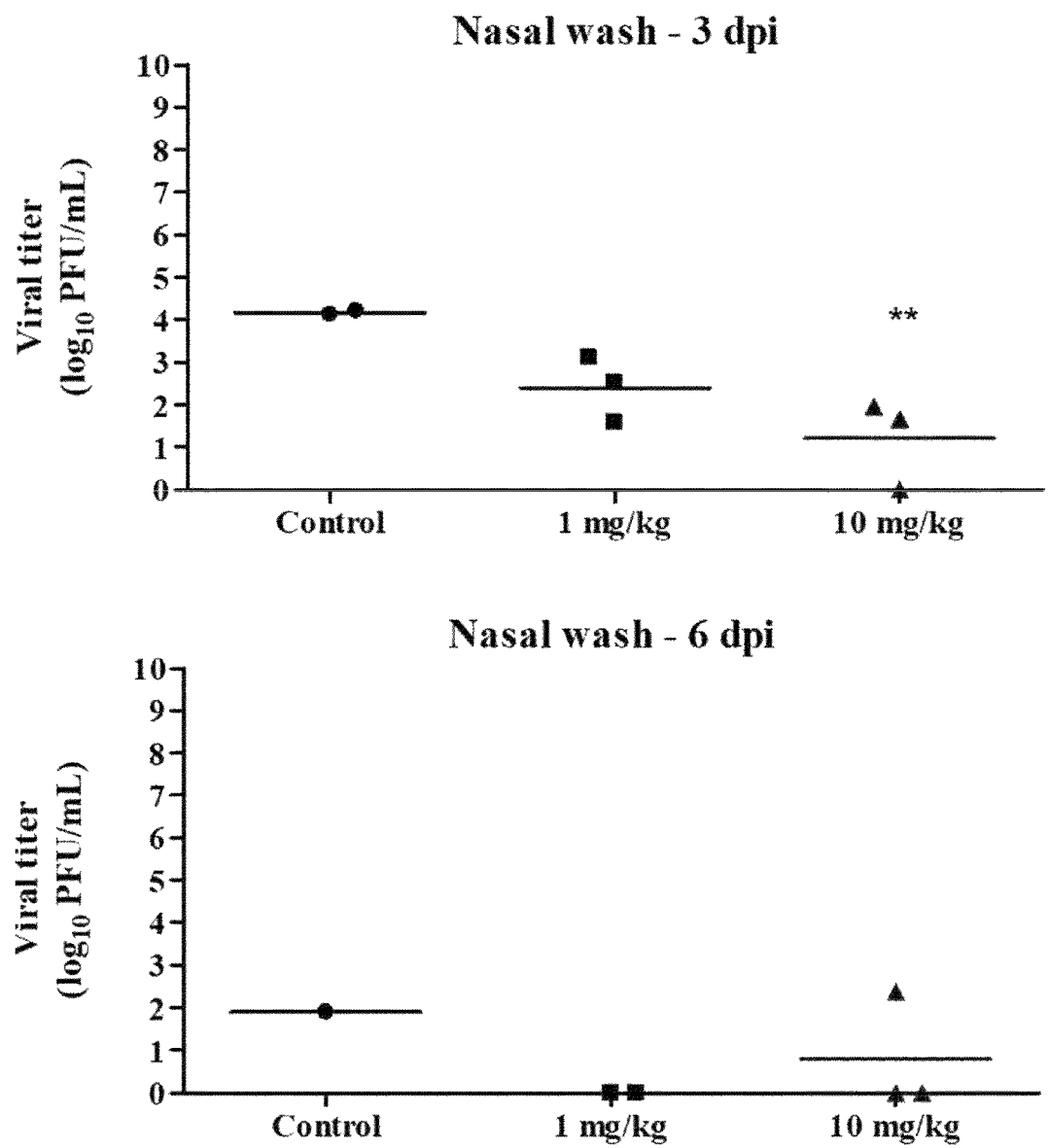
FIG. 6c shows the results of measurement of the virus titer of the nasal lavage of mice using Vero cells after viral inoculation with SARS-CoV-2 during the mouse animal experiment using the binding molecule of the present invention.

Upon administration of 0.1, 1, and 10 mg/kg, the virus titers in the nasal lavage were decreased 2 times, 79 times, and 1304 times, respectively, compared to the control group on the $3^{rd}$ day after inoculation. In addition, the virus titers were decreased 1 time, 63 times, and 10 times, respectively, compared to the control group on the $6^{th}$ day after inoculation (FIG. 6c).

Example 12: Determination of Antigen-Antibody Affinity Using Surface Plasmon Resonance Technology A surface plasmon resonance assay determines the binding affinity of an antibody through kinetic measurement of forward and reverse reaction rate constants.

The binding of the No. 139 antibody to a purified recombinant SARS-CoV-2-RBD protein was determined through surface-plasmon-resonance-based measurement by a Biacore T200 instrument using a running buffer HBS-EP (10 mM HEPES [pH 7.4], 150 mM NaCl, 3 mM EDTA and 0.005% surfactant P20) at 25° C. About 150 RU of SARS-CoV-2-RBD protein diluted in 10 mM sodium acetate (pH 5.0) was directly immobilized at 8 µg/ml on a biosensor chip for CM5 research using a standard amine coupling kit according to the manufacturer's instructions and procedures. The portion thereof that did not react on the surface of the biosensor was blocked with ethanolamine. Biacore T200 control software and Biacore T200 evaluation software were used for reaction analysis. The No. 139 antibody was diluted in a HBS-EP buffer and injected onto the reaction matrix at a flow rate of 20 µℓ/min. During the assay, all measurements were performed using the capture surface without the captured recombinant SARS-CoV-2-RBD protein as a control group. The association and dissociation rate constants Ka ($M^{-1}s^{-1}$) and Kd ($s^{-1}$) were obtained at a flow rate of 20 µℓ/min by performing reaction binding measurement at different antigen concentrations ranging from 0.04 to 10 nM, as a 3-fold dilution series. Subsequently, the equilibrium dissociation constant KD (M) for the reaction between the antibody and the target antigen was calculated from the reaction rate constants using the following equation: KD=Kd/Ka. The binding is recorded by calculating the function of time and reaction rate constant.

Figure 7:
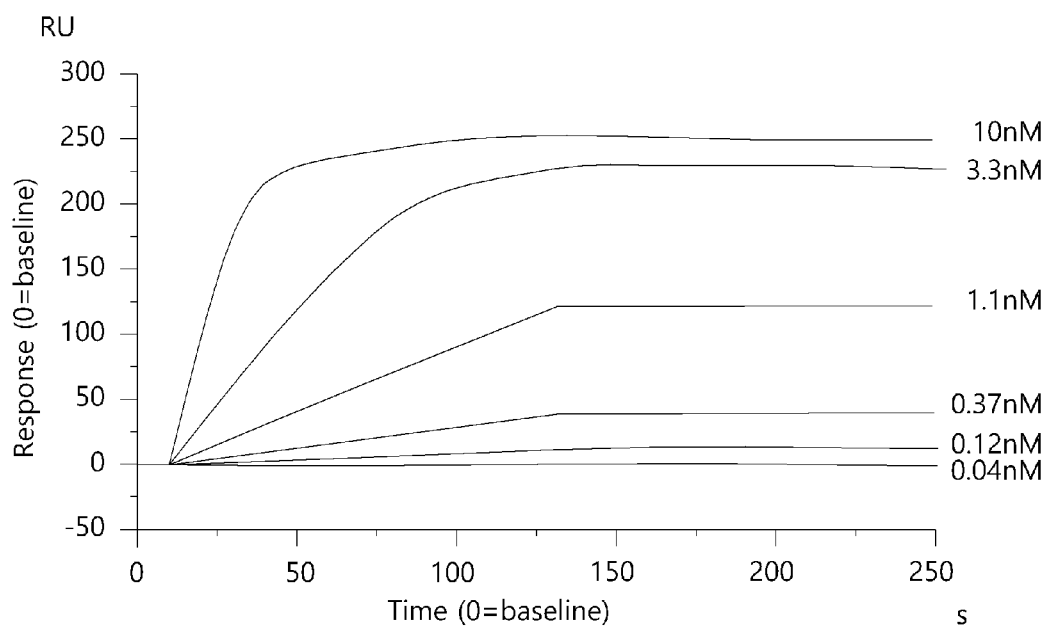
FIG. 7 shows the results of determination of binding affinity of the No. 139 antibody according to an embodiment of the present invention to a variety of purified recombinant SARS-CoV-2-RBD proteins.

The binding affinity of the No. 139 antibody to a variety of purified recombinant SARS-CoV-2-RBD proteins was determined (Table 13 below and FIG. 7). The No. 139 antibody exhibited high binding affinity to the SARS-CoV-2-RBD antigen.

TABLE 13

Measurement of binding affinity of No. 139 antibody to SARS-CoV-2-RBD protein

| No. | Ka ($M^{-1}s^{-1}$) | Kd ($s^{-1}$) | KD (M) | Average |
|---|---|---|---|---|
| No. 139 | 7.00E+06 | 1.58E−04 | 2.26E−11 | 2.71E−11 |
|  | 6.77E+06 | 2.14E−04 | 3.16E−11 |  |

Example 13: Analysis of Physicochemical Properties of No. 139 Antibody (Full IgG)

Based on the results of measurement of virus-neutralizing activity, one candidate having the highest neutralizing activity and excellent production yield was selected, and the physicochemical properties thereof were analyzed (Table 14 below).

Figure 8:
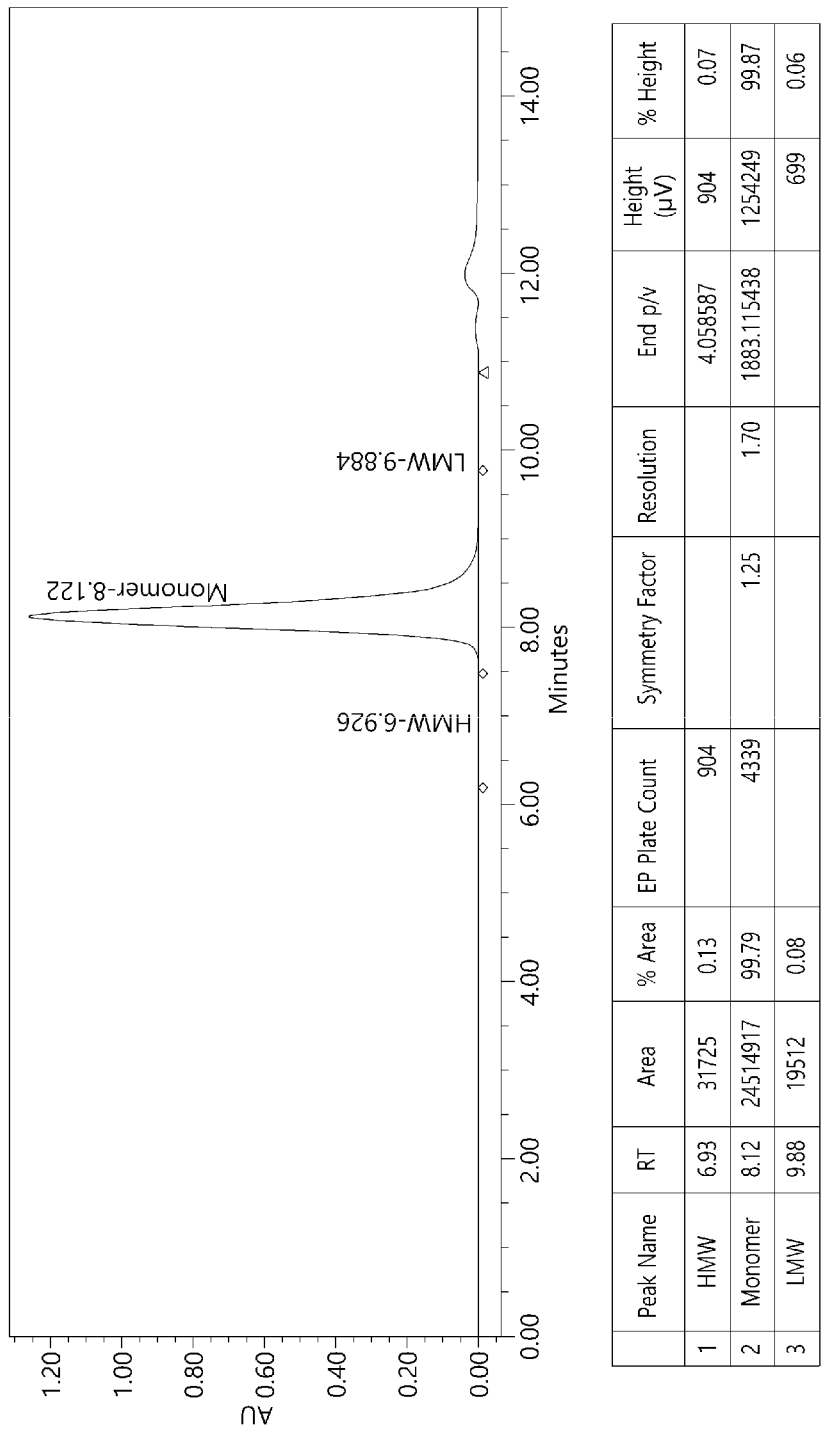
FIG. 8 shows the results of evaluation of the occurrence of abnormal fragment (LMW) or aggregation (HMW) of the antibody and the antibody structure ratio of the normal antibody using size exclusion chromatography (SEC-HPLC)

Size exclusion chromatography (SEC-HPLC) was used to evaluate the occurrence of abnormal fragment (LMW) or aggregation (HMW) of the antibody. Since this abnormal protein structure affects the antigen-specific binding ability of the original antibody and the pharmacokinetics in vivo, the superiority of general antibody production methods can be indirectly confirmed. The selected No. 139 exhibited the normal antibody structure ratio of 99.87% or more, indicating quality equal to or higher than that of commercially available monoclonal antibodies (FIG. 8).

Figure 9:
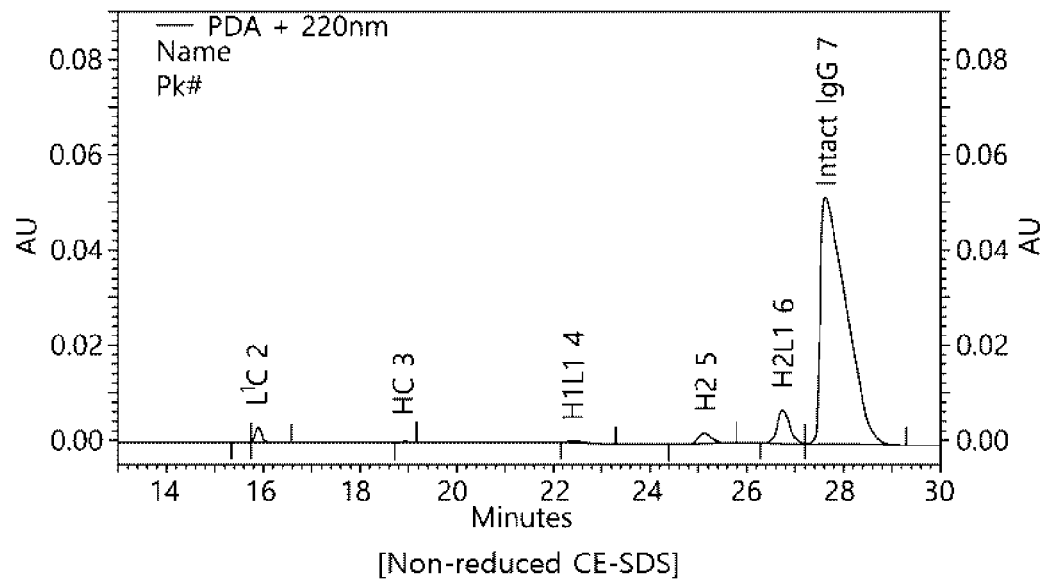
FIG. 9 shows the results of evaluation of the purity of intact IgG through non-reduced capillary electrophoresis (CE) and the sum of heavy and light chains through reduced CE.
Figure 9:
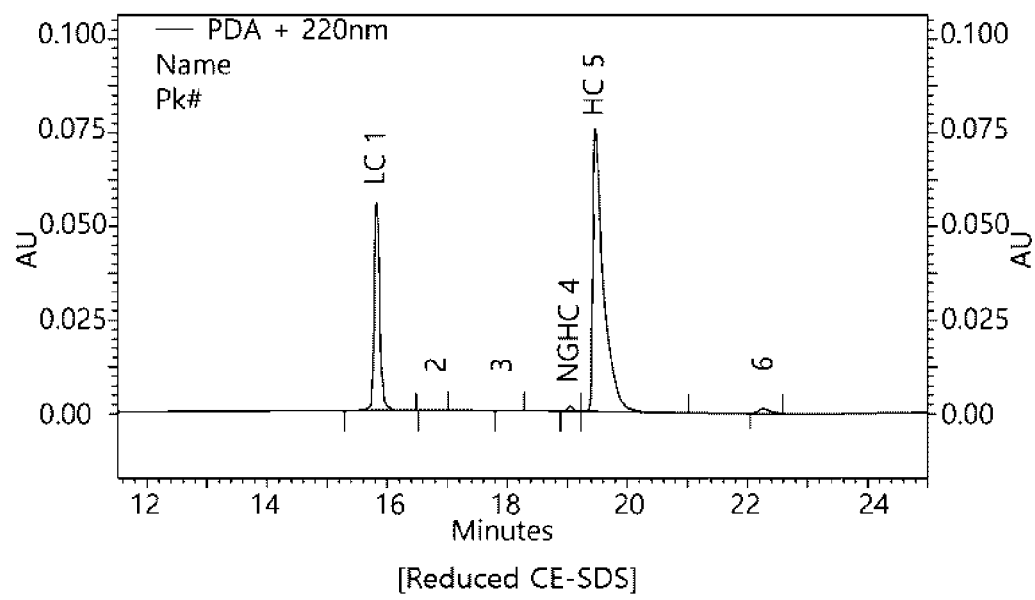

The purity of intact IgG through non-reduced capillary electrophoresis (CE) and the sum of heavy and light chains through reduced CE were evaluated (FIG. 9). The selected NO. 139 antibody exhibited purity of intact IgG of 89% through non-reduced CE, and the sum of heavy and light chains of 99% through reduced CE, indicating quality equal to or higher than that of commercially available monoclonal antibodies.

TABLE 14

Analysis of physicochemical properties of No. 139 antibody

| Evaluation method | | Result |
|---|---|---|
| SEC-HPLC | Monomer (%) | 99.87% |
|  | High Molecular Weight (HMW) (%) | 0.07% |
|  | Low Molecular Weight (LMW) (%) | 0.06% |
| Non-reduced CE-SDS | Intact IgG (%) | 89% |
| Reduced CE-SDS | Sum of Heavy & Light Chain (%) | 99% |

Example 14: Evaluation of Binding Specificity and Mechanism of Action of No. 139 Antibody (Full IgG)

The binding specificity of the No. 139 antibody (full IgG) selected in Examples 6, 7, 8 and 9 was evaluated through Octet analysis.

Figure 10:
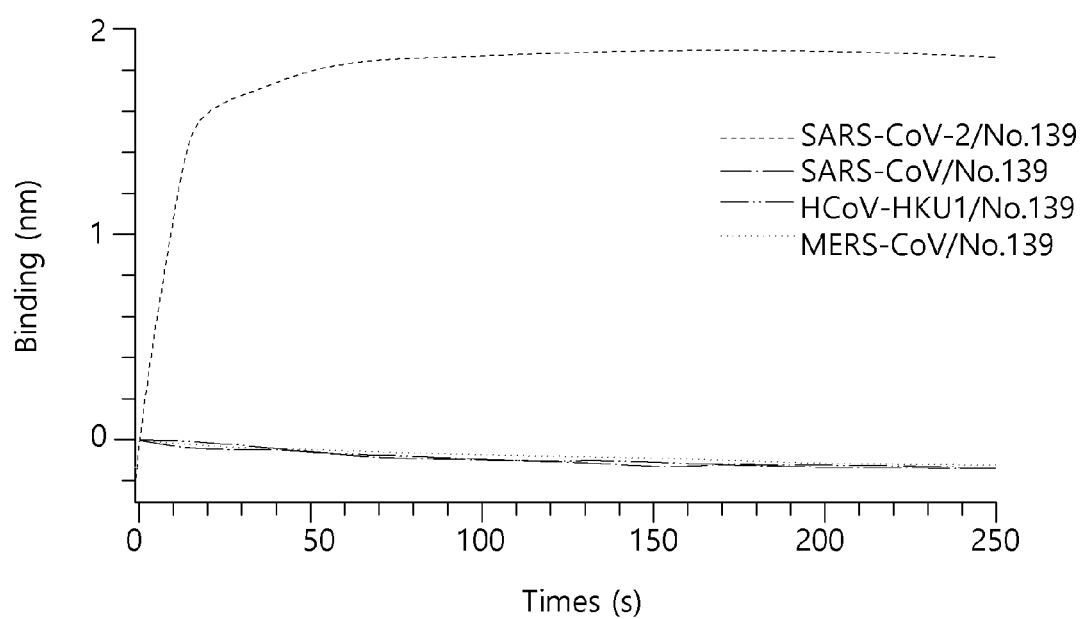
FIG. 10 shows the results of evaluation of the binding specificity of the No. 139 antibody according to an embodiment of the present invention through Octet analysis.

Based on the results of analysis, as shown in FIG. 10, the ability thereof to specifically bind to SARS-CoV-2 was confirmed. In FIG. 10, SARS-CoV S1, HCoV-HKU1 S1, and MERS-CoV RBD refer to the surface proteins of viruses that cause SARS, the common cold, and MERS, respectively.

Figure 11:
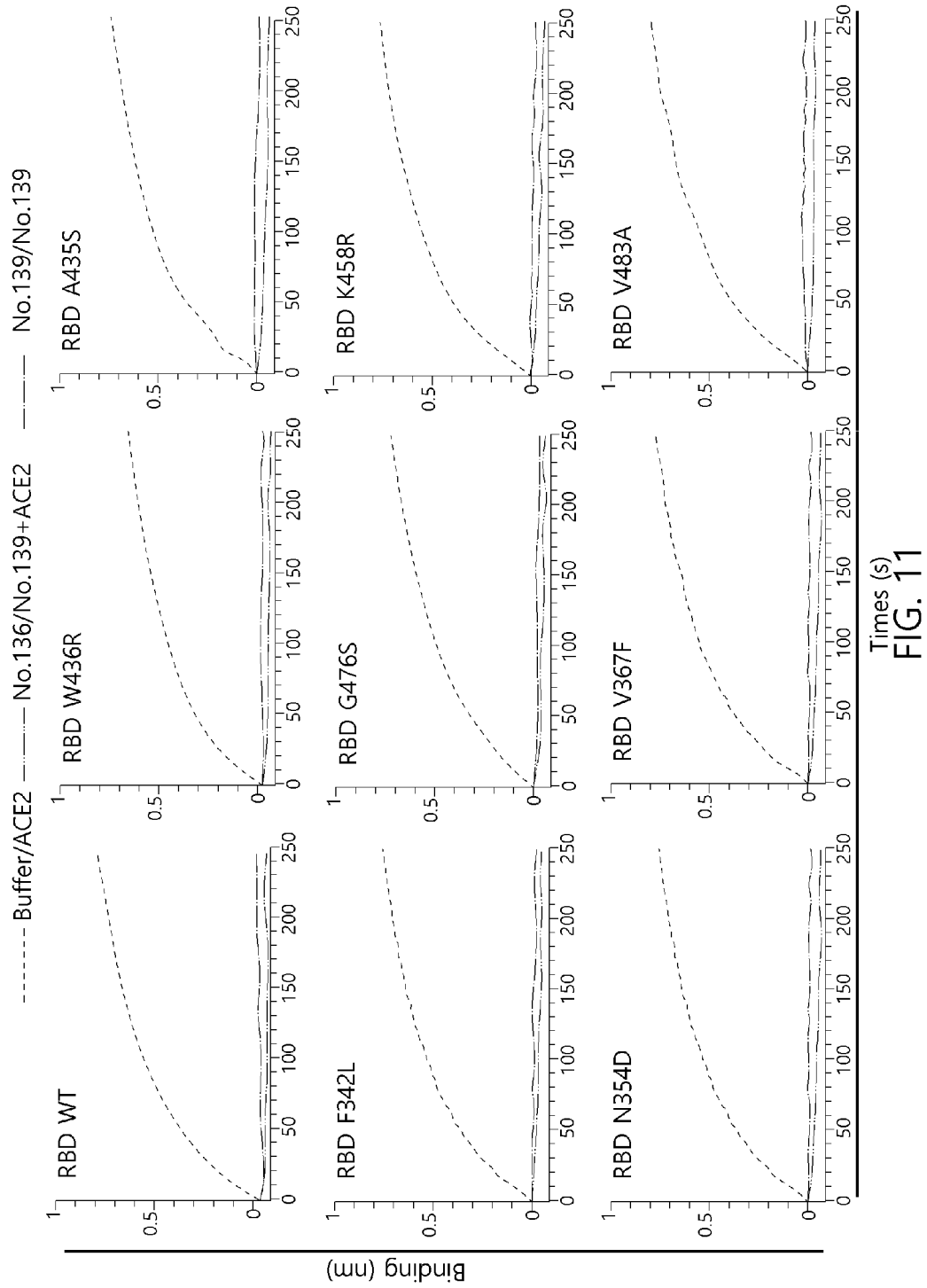
FIG. 11 shows the results of evaluation of the mechanism of action of the No. 139 antibody according to an embodiment of the present invention through biolayer interference (BLI) analysis using Octet.

SARS-CoV-2 can initiate infection into human cells by binding of the surface protein (RBD) thereof to the human receptor (ACE2). Therefore, the mechanism of action of the No. 139 antibody (full IgG) was evaluated by performing biolayer interference (BLI) analysis using Octet. Based on the results of analysis, as shown in Table 15 below, the ability thereof to bind to the mutant protein of the SARS-CoV-2 surface protein (RBD) was high, and as shown in FIG. 11, the binding of the SARS-CoV-2 surface protein (RBD) and the human receptor (ACE2) was confirmed to be completely inhibited by the No. 139 antibody (full IgG).

TABLE 15

| No. | RBD types | ka (1/Ms) | kd (1/s) | $K_D$ (M) |
|---|---|---|---|---|
| 139 | WT | 7.08E+05 | 1.78E−04 | 2.51E−10 |
| 139 | A435S | 1.07E+06 | 3.01E−04 | 2.82E−10 |
| 139 | F342L | 9.81E+05 | 1.94E−04 | 1.98E−10 |
| 139 | G476S | 9.07E+05 | 1.46E−04 | 1.61E−10 |
| 139 | K458R | 1.04E+06 | 2.46E−04 | 2.36E−10 |
| 139 | N354D | 8.61E+05 | 2.53E−04 | 2.94E−10 |
| 139 | V367F | 9.07E+05 | 2.65E−04 | 2.92E−10 |
| 139 | V483A | 9.04E+05 | 3.54E−04 | 3.91E−10 |
| 139 | W436R | 8.16E+05 | 1.80E−04 | 2.21E−10 |

SEQUENCE LISTING (2322 sequences)

SEQ ID NO: 1 - protein, 11 aa, Artificial Sequence
  No. 1 LC CDR1
RASQSISSYLN

SEQ ID NO: 2 - protein, 7 aa, Artificial Sequence
  No. 1 LC CDR2
AASSLQS

SEQ ID NO: 3 - protein, 9 aa, Artificial Sequence
  No. 1 LC CDR3
QQSYSTPFT

SEQ ID NO: 4 - protein, 5 aa, Artificial Sequence
  No. 1 HC CDR1
DYAMH

SEQ ID NO: 5 - protein, 17 aa, Artificial Sequence
  No. 1 HC CDR2
GISWNSGRIGYADSVKG

SEQ ID NO: 6 - protein, 19 aa, Artificial Sequence
  No. 1 HC CDR3
GDCGGDCYSFLLGEDAFDI

SEQ ID NO: 7 - protein, 11 aa, Artificial Sequence
  No. 2 LC CDR1
RASQSISTYLN

SEQ ID NO: 8 - protein, 7 aa, Artificial Sequence
  No. 2 LC CDR2
AASSLQS

SEQ ID NO: 9 - protein, 9 aa, Artificial Sequence
  No. 2 LC CDR3
QQSYSIPHT

SEQ ID NO: 10 - protein, 5 aa, Artificial Sequence
  No. 2 HC CDR1
DYAMH

SEQ ID NO: 11 - protein, 17 aa, Artificial Sequence
  No. 2 HC CDR2
GISWNSGRIGYADSVKG

SEQ ID NO: 12 - protein, 19 aa, Artificial Sequence
  No. 2 HC CDR3
GDCGGDCYSFLLGEDAFDI

SEQ ID NO: 13 - protein, 11 aa, Artificial Sequence
  No. 3 LC CDR1
QASQDISNYLN

SEQ ID NO: 14 - protein, 7 aa, Artificial Sequence
  No. 3 LC CDR2
DASNLET

SEQ ID NO: 15 - protein, 9 aa, Artificial Sequence
  No. 3 LC CDR3
QQYDNLPIT

SEQ ID NO: 16 - protein, 5 aa, Artificial Sequence
  No. 3 HC CDR1
SYAMS

SEQ ID NO: 17 - protein, 17 aa, Artificial Sequence
  No. 3 HC CDR2
AISGSGGSTYYADSVKG

SEQ ID NO: 18 - protein, 19 aa, Artificial Sequence
  No. 3 HC CDR3
SLVSGRYCSGVTCYSWFDP

SEQ ID NO: 19 - protein, 11 aa, Artificial Sequence
  No. 4 LC CDR1
QASQDISNYLN

SEQ ID NO: 20 - protein, 7 aa, Artificial Sequence
  No. 4 LC CDR2
DASNLET

SEQ ID NO: 21 - protein, 9 aa, Artificial Sequence
  No. 4 LC CDR3
QQYDDLPIT

SEQ ID NO: 22 - protein, 5 aa, Artificial Sequence
  No. 4 HC CDR1
SYAMS

SEQ ID NO: 23 - protein, 17 aa, Artificial Sequence
  No. 4 HC CDR2
AISGSGGSTYYADSVKG

SEQ ID NO: 24 - protein, 19 aa, Artificial Sequence
  No. 4 HC CDR3
SLVSGRYCSGVTCYSWFDP

SEQ ID NO: 25 - protein, 11 aa, Artificial Sequence
  No. 5 LC CDR1
QASQDISNYLN

SEQ ID NO: 26 - protein, 7 aa, Artificial Sequence
  No. 5 LC CDR2
DASNLET

SEQ ID NO: 27 - protein, 9 aa, Artificial Sequence
  No. 5 LC CDR3
QQYDNLPIT

SEQ ID NO: 28 - protein, 5 aa, Artificial Sequence
  No. 5 HC CDR1
SYAMS

SEQ ID NO: 29 - protein, 17 aa, Artificial Sequence
  No. 5 HC CDR2
AISGSGGSTYYADSVKG

SEQ ID NO: 30 - protein, 19 aa, Artificial Sequence
  No. 5 HC CDR3
SLVSGRYCSGVTCYSWFDP

SEQ ID NO: 31 - protein, 13 aa, Artificial Sequence
  No. 6 LC CDR1
SGSSSNIGSNYVY

SEQ ID NO: 32 - protein, 7 aa, Artificial Sequence
  No. 6 LC CDR2
RNNQRPS

SEQ ID NO: 33 - protein, 11 aa, Artificial Sequence
  No. 6 LC CDR3
AAWDDSLSGKV

SEQ ID NO: 34 - protein, 5 aa, Artificial Sequence
  No. 6 HC CDR1
SYAIS

SEQ ID NO: 35 - protein, 17 aa, Artificial Sequence
  No. 6 HC CDR2
GIIPIFGTANYAQKFQD

SEQ ID NO: 36 - protein, 22 aa, Artificial Sequence
  No. 6 HC CDR3
DGVVVPAVMYDTTDPYYYGMDV

SEQ ID NO: 37 - protein, 13 aa, Artificial Sequence
  No. 7 LC CDR1
SGSSSNIGSNYVY

SEQ ID NO: 38 - protein, 7 aa, Artificial Sequence
  No. 7 LC CDR2
RNNQRPP

SEQ ID NO: 39 - protein, 11 aa, Artificial Sequence
  No. 7 LC CDR3
AAWDDSLSGRV

SEQ ID NO: 40 - protein, 5 aa, Artificial Sequence
  No. 7 HC CDR1
SYAIS

SEQ ID NO: 41 - protein, 17 aa, Artificial Sequence
  No. 7 HC CDR2
GIIPIFGTANYAQKFQG

SEQ ID NO: 42 - protein, 22 aa, Artificial Sequence
  No. 7 HC CDR3
DGVVVPAVMYDTTDPYYYGMDV

SEQ ID NO: 43 - protein, 13 aa, Artificial Sequence
  No.8 LC CDR1
SGSSSNIGSNYVY

SEQ ID NO: 44 - protein, 7 aa, Artificial Sequence
  No.8 LC CDR2
RNNQRPS

SEQ ID NO: 45 - protein, 11 aa, Artificial Sequence
  No.8 LC CDR3
AAWDDSLSGRV

SEQ ID NO: 46 - protein, 5 aa, Artificial Sequence
  No.8 HC CDR1
SYAIS

SEQ ID NO: 47 - protein, 17 aa, Artificial Sequence
  No.8 HC CDR2
GIIPIFGTANYAQKFQG

SEQ ID NO: 48 - protein, 22 aa, Artificial Sequence
  No.8 HC CDR3
DGVVVPAVMYDTTDPYYYGMDV

SEQ ID NO: 49 - protein, 13 aa, Artificial Sequence
  No.9 LC CDR1
SGSSSNIGSNYVY

SEQ ID NO: 50 - protein, 7 aa, Artificial Sequence
  No.9 LC CDR2
RNNQRPS

SEQ ID NO: 51 - protein, 11 aa, Artificial Sequence
  No.9 LC CDR3
AAWDDSLNGRV

SEQ ID NO: 52 - protein, 5 aa, Artificial Sequence
  No.9 HC CDR1
SYAIS

SEQ ID NO: 53 - protein, 17 aa, Artificial Sequence
  No.9 HC CDR2
GIIPIFGTANYAQKFQG

SEQ ID NO: 54 - protein, 22 aa, Artificial Sequence
  No.9 HC CDR3
DGVVVPAVMYDTTDPYYYGMDV

SEQ ID NO: 55 - protein, 13 aa, Artificial Sequence
  No.10 LC CDR1
SGSSSNIGSNYVY

SEQ ID NO: 56 - protein, 7 aa, Artificial Sequence
  No.10 LC CDR2
RNNQRPS

SEQ ID NO: 57 - protein, 11 aa, Artificial Sequence
  No.10 LC CDR3
AAWDDSLSGRV

SEQ ID NO: 58 - protein, 5 aa, Artificial Sequence
  No.10 HC CDR1
SYAIS

SEQ ID NO: 59 - protein, 17 aa, Artificial Sequence
  No.10 HC CDR2
GIIPIFGTENYAQKFQG

SEQ ID NO: 60 - protein, 22 aa, Artificial Sequence
  No.10 HC CDR3
DGVVVPAVMYDTTDPYYYGMDV

SEQ ID NO: 61 - protein, 13 aa, Artificial Sequence
  No.11 LC CDR1
SGSSSNIGSNYVY

SEQ ID NO: 62 - protein, 7 aa, Artificial Sequence
  No.11 LC CDR2
RNNQRPS

SEQ ID NO: 63 - protein, 11 aa, Artificial Sequence
  No.11 LC CDR3
AAWDDSLSGRV

SEQ ID NO: 64 - protein, 5 aa, Artificial Sequence
  No.11 HC CDR1
SYAIS

SEQ ID NO: 65 - protein, 17 aa, Artificial Sequence
  No.11 HC CDR2
GIIPIFGTENYAQKFQG

SEQ ID NO: 66 - protein, 22 aa, Artificial Sequence
  No.11 HC CDR3
DGVVVPAVMYDTTDPYYYGMDV

SEQ ID NO: 67 - protein, 13 aa, Artificial Sequence
  No.12 LC CDR1
SGSSSNIGSNYVY

SEQ ID NO: 68 - protein, 7 aa, Artificial Sequence
  No.12 LC CDR2
RNNQRPS

SEQ ID NO: 69 - protein, 11 aa, Artificial Sequence
  No.12 LC CDR3
AAWDDSLSGKV

SEQ ID NO: 70 - protein, 5 aa, Artificial Sequence
  No.12 HC CDR1
SYAIS

SEQ ID NO: 71 - protein, 17 aa, Artificial Sequence
  No.12 HC CDR2
GIIPIFGTANYAQKFQD

SEQ ID NO: 72 - protein, 22 aa, Artificial Sequence
  No.12 HC CDR3
DGVVVPAVMYDTTDPYYYGMDV

SEQ ID NO: 73 - protein, 13 aa, Artificial Sequence
  No.13 LC CDR1
SGSSSNIGNNYVY

SEQ ID NO: 74 - protein, 7 aa, Artificial Sequence
  No.13 LC CDR2
GNYQRPS

SEQ ID NO: 75 - protein, 11 aa, Artificial Sequence
  No.13 LC CDR3
AAWDDSLSGRV

SEQ ID NO: 76 - protein, 5 aa, Artificial Sequence
  No.13 HC CDR1
SYAIS

SEQ ID NO: 77 - protein, 17 aa, Artificial Sequence
  No.13 HC CDR2
GIIPIFGTANYAQKFQG

SEQ ID NO: 78 - protein, 22 aa, Artificial Sequence
  No.13 HC CDR3
DGVVVPAVMYDTTDPYYYGMDV

SEQ ID NO: 79 - protein, 13 aa, Artificial Sequence
  No.14 LC CDR1
SGSSSNIGGNYVH

SEQ ID NO: 80 - protein, 7 aa, Artificial Sequence
  No.14 LC CDR2
SNDQRPS

SEQ ID NO: 81 - protein, 11 aa, Artificial Sequence
  No.14 LC CDR3
AAWDDSLNGRV

SEQ ID NO: 82 - protein, 5 aa, Artificial Sequence
  No.14 HC CDR1
SYAIS

SEQ ID NO: 83 - protein, 17 aa, Artificial Sequence
  No.14 HC CDR2
GIIPIFGTANYAQKFQG

SEQ ID NO: 84 - protein, 22 aa, Artificial Sequence
  No.14 HC CDR3
DGVVVPAVMYDTTDPYYYGMDV

SEQ ID NO: 85 - protein, 13 aa, Artificial Sequence
  No.15 LC CDR1
SGSSSNIGSNYVY

SEQ ID NO: 86 - protein, 7 aa, Artificial Sequence
  No.15 LC CDR2
RNNQRPP

SEQ ID NO: 87 - protein, 11 aa, Artificial Sequence
  No.15 LC CDR3
AAWDDSLSGRV

SEQ ID NO: 88 - protein, 5 aa, Artificial Sequence
  No.15 HC CDR1
SYAIS

SEQ ID NO: 89 - protein, 17 aa, Artificial Sequence
  No.15 HC CDR2
GIIPIFGTANYAQKFQG

SEQ ID NO: 90 - protein, 22 aa, Artificial Sequence
  No.15 HC CDR3
DGVVVPAVMYDTTDPYYYGMDV

SEQ ID NO: 91 - protein, 13 aa, Artificial Sequence
  No.16 LC CDR1
SGSSSNIGSNYVY

SEQ ID NO: 92 - protein, 7 aa, Artificial Sequence
  No.16 LC CDR2
RNNQRPS

SEQ ID NO: 93 - protein, 11 aa, Artificial Sequence
  No.16 LC CDR3
AAWDDSLSGKV

SEQ ID NO: 94 - protein, 5 aa, Artificial Sequence
  No.16 HC CDR1
SYAIS

SEQ ID NO: 95 - protein, 17 aa, Artificial Sequence
  No.16 HC CDR2
GIIPIFGTANYAQKFQD

SEQ ID NO: 96 - protein, 22 aa, Artificial Sequence
  No.16 HC CDR3
DGVVVPAVMYDTTDPYYYGMDV

SEQ ID NO: 97 - protein, 13 aa, Artificial Sequence
  No.17 LC CDR1
SGSSSNIGSNYVY

SEQ ID NO: 98 - protein, 7 aa, Artificial Sequence
  No.17 LC CDR2
RNNQRPS

SEQ ID NO: 99 - protein, 11 aa, Artificial Sequence
  No.17 LC CDR3
AAWDDSLSGKV

SEQ ID NO: 100 - protein, 5 aa, Artificial Sequence
  No.17 HC CDR1
SYAIS

SEQ ID NO: 101 - protein, 17 aa, Artificial Sequence
  No.17 HC CDR2
GIIPIFGTANYAQKFQD

SEQ ID NO: 102 - protein, 22 aa, Artificial Sequence
  No.17 HC CDR3
DGVVVPAVMYDTTDPYYYGMDV

SEQ ID NO: 103 - protein, 14 aa, Artificial Sequence
  No.18 LC CDR1
TGSSSNIGAGYDVH

SEQ ID NO: 104 - protein, 7 aa, Artificial Sequence
  No.18 LC CDR2
GNSNRPS

SEQ ID NO: 105 - protein, 11 aa, Artificial Sequence
  No.18 LC CDR3
QSYDSSLSGKV

SEQ ID NO: 106 - protein, 5 aa, Artificial Sequence
  No.18 HC CDR1
SYAIS

SEQ ID NO: 107 - protein, 17 aa, Artificial Sequence
  No.18 HC CDR2
GIIPIFGTANYAQKFQG

SEQ ID NO: 108 - protein, 22 aa, Artificial Sequence
  No.18 HC CDR3
DGVVVPAVMYDTTDPYYYGMDV

SEQ ID NO: 109 - protein, 13 aa, Artificial Sequence
  No.19 LC CDR1
SGSSSNIGSNYVY

SEQ ID NO: 110 - protein, 7 aa, Artificial Sequence
  No.19 LC CDR2
RNNQRPS

SEQ ID NO: 111 - protein, 11 aa, Artificial Sequence
  No.19 LC CDR3
AAWDDSLSGRV

SEQ ID NO: 112 - protein, 5 aa, Artificial Sequence
  No.19 HC CDR1
SYAIS

SEQ ID NO: 113 - protein, 17 aa, Artificial Sequence
  No.19 HC CDR2
GIIPIFGTANYAQKFQG

SEQ ID NO: 114 - protein, 22 aa, Artificial Sequence
  No.19 HC CDR3
DGVVVPAVMYDTTDPYYYGMDV

SEQ ID NO: 115 - protein, 13 aa, Artificial Sequence
  No.20 LC CDR1
SGSSSNIGSNYVY

SEQ ID NO: 116 - protein, 7 aa, Artificial Sequence
  No.20 LC CDR2
RNNQRPS

SEQ ID NO: 117 - protein, 11 aa, Artificial Sequence
  No.20 LC CDR3
AAWDDSLSGKV

SEQ ID NO: 118 - protein, 5 aa, Artificial Sequence
  No.20 HC CDR1
SYAIS

SEQ ID NO: 119 - protein, 17 aa, Artificial Sequence
  No.20 HC CDR2
GIIPIFGTANYAQKFQD

SEQ ID NO: 120 - protein, 22 aa, Artificial Sequence
  No.20 HC CDR3
DGVVVPAVMYDTTDPYYYGMDV

SEQ ID NO: 121 - protein, 13 aa, Artificial Sequence
  No.21 LC CDR1
SGSSSNIGSNYVY

SEQ ID NO: 122 - protein, 7 aa, Artificial Sequence
  No.21 LC CDR2
RNNQRPS

SEQ ID NO: 123 - protein, 11 aa, Artificial Sequence
  No.21 LC CDR3
AAWDDSLSGKV

SEQ ID NO: 124 - protein, 5 aa, Artificial Sequence
  No.21 HC CDR1
SYAIS

SEQ ID NO: 125 - protein, 17 aa, Artificial Sequence
  No.21 HC CDR2
GIIPIFGTANYAQKFQD

SEQ ID NO: 126 - protein, 22 aa, Artificial Sequence
  No.21 HC CDR3
DGVVVPAVMYDTTDPYYYGMDV

SEQ ID NO: 127 - protein, 13 aa, Artificial Sequence
  No.22 LC CDR1
SGSSSNIGSNYVY

SEQ ID NO: 128 - protein, 7 aa, Artificial Sequence
  No.22 LC CDR2
RNNQRPS

SEQ ID NO: 129 - protein, 11 aa, Artificial Sequence
  No.22 LC CDR3
AAWDDSLSGKV

SEQ ID NO: 130 - protein, 5 aa, Artificial Sequence
  No.22 HC CDR1
SYAIS

SEQ ID NO: 131 - protein, 17 aa, Artificial Sequence
  No.22 HC CDR2
GIIPIFGTANYAQKFQD

SEQ ID NO: 132 - protein, 22 aa, Artificial Sequence
  No.22 HC CDR3
DGVVVPAVMYDTTDPYYYGMDV

SEQ ID NO: 133 - protein, 13 aa, Artificial Sequence
  No.23 LC CDR1
SGSSSNIGSNYVY

SEQ ID NO: 134 - protein, 7 aa, Artificial Sequence
  No.23 LC CDR2
RNNQRPS

SEQ ID NO: 135 - protein, 11 aa, Artificial Sequence
  No.23 LC CDR3
AAWDDSLSGKV

SEQ ID NO: 136 - protein, 5 aa, Artificial Sequence
  No.23 HC CDR1
SYAIS

SEQ ID NO: 137 - protein, 17 aa, Artificial Sequence
  No.23 HC CDR2
GIIPIFGTANYAQKFQD

SEQ ID NO: 138 - protein, 22 aa, Artificial Sequence
  No.23 HC CDR3
DGVVVPAVMYDTTDPYYYGMDV

SEQ ID NO: 139 - protein, 13 aa, Artificial Sequence
  No.24 LC CDR1
SGSSSNIGSNYVY

SEQ ID NO: 140 - protein, 7 aa, Artificial Sequence
  No.24 LC CDR2
RNNQRPP

SEQ ID NO: 141 - protein, 11 aa, Artificial Sequence
  No.24 LC CDR3
AAWDDSLSGRV

SEQ ID NO: 142 - protein, 5 aa, Artificial Sequence
  No.24 HC CDR1
SYAIS

SEQ ID NO: 143 - protein, 17 aa, Artificial Sequence
  No.24 HC CDR2
GIIPIFGTANYAQKFQG

SEQ ID NO: 144 - protein, 22 aa, Artificial Sequence
  No.24 HC CDR3
DGVVVPAVMYDTTDPYYYGMDV

SEQ ID NO: 145 - protein, 13 aa, Artificial Sequence
  No.25 LC CDR1
SGSSSNIGSNYVY

SEQ ID NO: 146 - protein, 7 aa, Artificial Sequence
  No.25 LC CDR2
RNNQRPS

SEQ ID NO: 147 - protein, 11 aa, Artificial Sequence
  No.25 LC CDR3
AAWDDSLSGKV

SEQ ID NO: 148 - protein, 5 aa, Artificial Sequence
  No.25 HC CDR1
SYAIS

SEQ ID NO: 149 - protein, 17 aa, Artificial Sequence
  No.25 HC CDR2
GIIPIFGTANYAQKFQD

SEQ ID NO: 150 - protein, 22 aa, Artificial Sequence
  No.25 HC CDR3
DGVVVPAVMYDTTDPYYYGMDV

SEQ ID NO: 151 - protein, 13 aa, Artificial Sequence
  No.26 LC CDR1
SGSSSNIGSNYVY

SEQ ID NO: 152 - protein, 7 aa, Artificial Sequence
  No.26 LC CDR2
RNNQRPS

SEQ ID NO: 153 - protein, 11 aa, Artificial Sequence
  No.26 LC CDR3
AAWDDSLSGKV

SEQ ID NO: 154 - protein, 5 aa, Artificial Sequence
  No.26 HC CDR1
SYAIS

SEQ ID NO: 155 - protein, 17 aa, Artificial Sequence
  No.26 HC CDR2
GIIPIFGTANYAQKFQD

SEQ ID NO: 156 - protein, 22 aa, Artificial Sequence
  No.26 HC CDR3
DGVVVPAVMYDTTDPYYYGMDV

SEQ ID NO: 157 - protein, 13 aa, Artificial Sequence
  No.27 LC CDR1
SGSSSNIGSNYVY

SEQ ID NO: 158 - protein, 7 aa, Artificial Sequence
  No.27 LC CDR2
RNNQRPS

SEQ ID NO: 159 - protein, 11 aa, Artificial Sequence
  No.27 LC CDR3
AAWDDSLSGKV

SEQ ID NO: 160 - protein, 5 aa, Artificial Sequence
  No.27 HC CDR1
SYAIS

SEQ ID NO: 161 - protein, 17 aa, Artificial Sequence
  No.27 HC CDR2
GIIPIFGTANYAQKFQD

SEQ ID NO: 162 - protein, 22 aa, Artificial Sequence
  No.27 HC CDR3
DGVVVPAVMYDTTDPYYYGMDV

SEQ ID NO: 163 - protein, 13 aa, Artificial Sequence
  No.28 LC CDR1
SGSSSNIGSNYVY

SEQ ID NO: 164 - protein, 7 aa, Artificial Sequence
  No.28 LC CDR2
RNNQRPS

SEQ ID NO: 165 - protein, 11 aa, Artificial Sequence
  No.28 LC CDR3
AAWDDSLNGRV

SEQ ID NO: 166 - protein, 5 aa, Artificial Sequence
  No.28 HC CDR1
SYAIS

SEQ ID NO: 167 - protein, 17 aa, Artificial Sequence
  No.28 HC CDR2
GIIPIFGTANYAQKFQG

SEQ ID NO: 168 - protein, 22 aa, Artificial Sequence
  No.28 HC CDR3
DGVVVPAVMYDTTDPYYYGMDV

SEQ ID NO: 169 - protein, 13 aa, Artificial Sequence
  No.29 LC CDR1
SGSSSNIGSNYVY

SEQ ID NO: 170 - protein, 7 aa, Artificial Sequence
  No.29 LC CDR2
RNNQRPS

SEQ ID NO: 171 - protein, 11 aa, Artificial Sequence
  No.29 LC CDR3
AAWDDSLSGKV

SEQ ID NO: 172 - protein, 5 aa, Artificial Sequence
  No.29 HC CDR1
SYAIS

SEQ ID NO: 173 - protein, 17 aa, Artificial Sequence
  No.29 HC CDR2
GIIPIFGTANYAQKFQD

SEQ ID NO: 174 - protein, 22 aa, Artificial Sequence
  No.29 HC CDR3
DGVVVPAVMYDTTDPYYYGMDV

SEQ ID NO: 175 - protein, 13 aa, Artificial Sequence
  No.30 LC CDR1
SGSSSNIGSNYVY

SEQ ID NO: 176 - protein, 7 aa, Artificial Sequence
  No.30 LC CDR2
RNNQRPS

SEQ ID NO: 177 - protein, 11 aa, Artificial Sequence
  No.30 LC CDR3
AAWDDSLSGKV

SEQ ID NO: 178 - protein, 5 aa, Artificial Sequence
  No.30 HC CDR1
SYAIS

SEQ ID NO: 179 - protein, 17 aa, Artificial Sequence
  No.30 HC CDR2
GIIPIFGTANYAQKFQD

SEQ ID NO: 180 - protein, 22 aa, Artificial Sequence
  No.30 HC CDR3
DGVVVPAVMYDTTDPYYYGMDV

SEQ ID NO: 181 - protein, 13 aa, Artificial Sequence
  No.31 LC CDR1
SGSSSNIGGNYVH

SEQ ID NO: 182 - protein, 7 aa, Artificial Sequence
  No.31 LC CDR2
SNDQRPS

SEQ ID NO: 183 - protein, 11 aa, Artificial Sequence
  No.31 LC CDR3
AAWDDSLSGRV

SEQ ID NO: 184 - protein, 5 aa, Artificial Sequence
  No.31 HC CDR1
SYAIS

SEQ ID NO: 185 - protein, 17 aa, Artificial Sequence
  No.31 HC CDR2
GIIPIFGTANYAQKFQG

SEQ ID NO: 186 - protein, 22 aa, Artificial Sequence
  No.31 HC CDR3
DGVVVPAVMYDTTDPYYYGMDV

SEQ ID NO: 187 - protein, 13 aa, Artificial Sequence
  No.32 LC CDR1
SGSSSNIGSNYVY

SEQ ID NO: 188 - protein, 7 aa, Artificial Sequence
  No.32 LC CDR2
RNNQRPS

SEQ ID NO: 189 - protein, 11 aa, Artificial Sequence
  No.32 LC CDR3
AAWDDSLSGKV

SEQ ID NO: 190 - protein, 5 aa, Artificial Sequence
  No.32 HC CDR1
SYAIS

SEQ ID NO: 191 - protein, 17 aa, Artificial Sequence
  No.32 HC CDR2
GIIPIFGTANYAQKFQD

SEQ ID NO: 192 - protein, 22 aa, Artificial Sequence
  No.32 HC CDR3
DGVVVPAVMYDTTDPYYYGMDV

SEQ ID NO: 193 - protein, 13 aa, Artificial Sequence
  No.33 LC CDR1
SGSSSNIGSNYVY

SEQ ID NO: 194 - protein, 7 aa, Artificial Sequence
  No.33 LC CDR2
RNNQRPS

SEQ ID NO: 195 - protein, 11 aa, Artificial Sequence
  No.33 LC CDR3
AAWDDSLSGKV

SEQ ID NO: 196 - protein, 5 aa, Artificial Sequence
  No.33 HC CDR1
SYAIS

SEQ ID NO: 197 - protein, 17 aa, Artificial Sequence
  No.33 HC CDR2
GIIPIFGTANYAQKFQD

SEQ ID NO: 198 - protein, 22 aa, Artificial Sequence
  No.33 HC CDR3
DGVVVPAVMYDTTDPYYYGMDV

SEQ ID NO: 199 - protein, 13 aa, Artificial Sequence
  No.34 LC CDR1
SGSSSNIGSNYVY

SEQ ID NO: 200 - protein, 7 aa, Artificial Sequence
  No.34 LC CDR2
RNNQRPS

SEQ ID NO: 201 - protein, 11 aa, Artificial Sequence
  No.34 LC CDR3
AAWDDSLSGRV

SEQ ID NO: 202 - protein, 5 aa, Artificial Sequence
  No.34 HC CDR1
SYAIS

SEQ ID NO: 203 - protein, 17 aa, Artificial Sequence
  No.34 HC CDR2
GIIPIFGTANYAQKFQG

SEQ ID NO: 204 - protein, 22 aa, Artificial Sequence
  No.34 HC CDR3
DGVVVPAVMYDTTDPYYYGMDV

SEQ ID NO: 205 - protein, 13 aa, Artificial Sequence
  No.35 LC CDR1
SGSSSNIGSNYVY

SEQ ID NO: 206 - protein, 7 aa, Artificial Sequence
  No.35 LC CDR2
RNNQRPS

SEQ ID NO: 207 - protein, 11 aa, Artificial Sequence
  No.35 LC CDR3
AAWDDSLSGRV

SEQ ID NO: 208 - protein, 5 aa, Artificial Sequence
  No.35 HC CDR1
SYAIS

SEQ ID NO: 209 - protein, 17 aa, Artificial Sequence
  No.35 HC CDR2
GIIPIFGTANYAQKFQG

SEQ ID NO: 210 - protein, 22 aa, Artificial Sequence
  No.35 HC CDR3
DGVVVPAVMYDTTDPYYYGMDV

SEQ ID NO: 211 - protein, 13 aa, Artificial Sequence
  No.36 LC CDR1
SGGSSNIGSNYVY

SEQ ID NO: 212 - protein, 7 aa, Artificial Sequence
  No.36 LC CDR2
RNNQRPS

SEQ ID NO: 213 - protein, 11 aa, Artificial Sequence
  No.36 LC CDR3
AAWDDSLSGRV

SEQ ID NO: 214 - protein, 5 aa, Artificial Sequence
  No.36 HC CDR1
SYAIS

SEQ ID NO: 215 - protein, 17 aa, Artificial Sequence
  No.36 HC CDR2
GIIPIFGTANYAQKFQG

SEQ ID NO: 216 - protein, 22 aa, Artificial Sequence
  No.36 HC CDR3
DGVVVPAVMYDTTDPYYYGMDV

SEQ ID NO: 217 - protein, 13 aa, Artificial Sequence
  No.37 LC CDR1
SGSSSNIGSNYVY

SEQ ID NO: 218 - protein, 7 aa, Artificial Sequence
  No.37 LC CDR2
RNNQRPP

SEQ ID NO: 219 - protein, 11 aa, Artificial Sequence
  No.37 LC CDR3
AAWDDSLSGRV

SEQ ID NO: 220 - protein, 5 aa, Artificial Sequence
  No.37 HC CDR1
SYAIS

SEQ ID NO: 221 - protein, 17 aa, Artificial Sequence
  No.37 HC CDR2
GIIPIFGTANYAQKFQG

SEQ ID NO: 222 - protein, 22 aa, Artificial Sequence
  No.37 HC CDR3
DGVVVPAVMYDTTDPYYYGMDV

SEQ ID NO: 223 - protein, 13 aa, Artificial Sequence
  No.38 LC CDR1
SGSSSNIGSNYVY

SEQ ID NO: 224 - protein, 7 aa, Artificial Sequence
  No.38 LC CDR2
RNNQRPS

SEQ ID NO: 225 - protein, 11 aa, Artificial Sequence
  No.38 LC CDR3
AAWDDSLSGRV

SEQ ID NO: 226 - protein, 5 aa, Artificial Sequence
  No.38 HC CDR1
SYAIS

SEQ ID NO: 227 - protein, 17 aa, Artificial Sequence
  No.38 HC CDR2
GIIPIFGTANYAQKFQG

SEQ ID NO: 228 - protein, 22 aa, Artificial Sequence
  No.38 HC CDR3
DGVVVPAVMYDTTDPYYYGMDV

SEQ ID NO: 229 - protein, 13 aa, Artificial Sequence
  No.39 LC CDR1
SGSSSNIGSNYVY

SEQ ID NO: 230 - protein, 7 aa, Artificial Sequence
  No.39 LC CDR2
RNNQRPS

SEQ ID NO: 231 - protein, 11 aa, Artificial Sequence
  No.39 LC CDR3
AAWDDSLSGRV

SEQ ID NO: 232 - protein, 5 aa, Artificial Sequence
  No.39 HC CDR1
SYAIS

SEQ ID NO: 233 - protein, 17 aa, Artificial Sequence
  No.39 HC CDR2
GIIPIFGTANYAQKFQG

SEQ ID NO: 234 - protein, 22 aa, Artificial Sequence
  No.39 HC CDR3
DGVVVPAVMYDTTDPYYYGMDV

SEQ ID NO: 235 - protein, 13 aa, Artificial Sequence
  No.40 LC CDR1
SGSSSNIGSNYVY

SEQ ID NO: 236 - protein, 7 aa, Artificial Sequence
  No.40 LC CDR2
RNNQRPS

SEQ ID NO: 237 - protein, 11 aa, Artificial Sequence
  No.40 LC CDR3
AAWDDSLSGRV

SEQ ID NO: 238 - protein, 5 aa, Artificial Sequence
  No.40 HC CDR1
SYAIS

SEQ ID NO: 239 - protein, 17 aa, Artificial Sequence
  No.40 HC CDR2
GIIPIFGTANYAQKFQG

SEQ ID NO: 240 - protein, 22 aa, Artificial Sequence
  No.40 HC CDR3
DGVVVPAVMYDTTDPYYYGMDV

SEQ ID NO: 241 - protein, 13 aa, Artificial Sequence
  No.41 LC CDR1
SGSSSNIGSNYVY

SEQ ID NO: 242 - protein, 7 aa, Artificial Sequence
  No.41 LC CDR2
RNNQRPS

SEQ ID NO: 243 - protein, 11 aa, Artificial Sequence
  No.41 LC CDR3
AAWDDSLSGKV

SEQ ID NO: 244 - protein, 5 aa, Artificial Sequence
  No.41 HC CDR1
SYAIS

SEQ ID NO: 245 - protein, 17 aa, Artificial Sequence
  No.41 HC CDR2
GIIPIFGTANYAQKFQD

SEQ ID NO: 246 - protein, 22 aa, Artificial Sequence
  No.41 HC CDR3
DGVVVPAVMYDTTDPYYYGMDV

SEQ ID NO: 247 - protein, 13 aa, Artificial Sequence
  No.42 LC CDR1
SGSSSNIGSNYVY

SEQ ID NO: 248 - protein, 7 aa, Artificial Sequence
  No.42 LC CDR2
RNNQRPS

SEQ ID NO: 249 - protein, 11 aa, Artificial Sequence
  No.42 LC CDR3
AAWDDSLSGKV

SEQ ID NO: 250 - protein, 5 aa, Artificial Sequence
  No.42 HC CDR1
SYAIS

SEQ ID NO: 251 - protein, 17 aa, Artificial Sequence
  No.42 HC CDR2
GIIPIFGTANYAQKFQD

SEQ ID NO: 252 - protein, 22 aa, Artificial Sequence
  No.42 HC CDR3
DGVVVPAVMYDTTDPYYYGMDV

SEQ ID NO: 253 - protein, 13 aa, Artificial Sequence
  No.43 LC CDR1
SGSSSNIGSNYVY

SEQ ID NO: 254 - protein, 7 aa, Artificial Sequence
  No.43 LC CDR2
RNNQRPP

SEQ ID NO: 255 - protein, 11 aa, Artificial Sequence
  No.43 LC CDR3
AAWDDSLSGRV

SEQ ID NO: 256 - protein, 5 aa, Artificial Sequence
  No.43 HC CDR1
SYAIS

SEQ ID NO: 257 - protein, 17 aa, Artificial Sequence
  No.43 HC CDR2
GIIPIFGTANYAQKFQG

SEQ ID NO: 258 - protein, 22 aa, Artificial Sequence
  No.43 HC CDR3
DGVVVPAVMYDTTDPYYYGMDV

SEQ ID NO: 259 - protein, 11 aa, Artificial Sequence
  No.44 LC CDR1
RASQSVSSYLA

SEQ ID NO: 260 - protein, 7 aa, Artificial Sequence
  No.44 LC CDR2
DASNRAT

SEQ ID NO: 261 - protein, 9 aa, Artificial Sequence
  No.44 LC CDR3
QQYVTTPYT

SEQ ID NO: 262 - protein, 7 aa, Artificial Sequence
  No.44 HC CDR1
RSSYYWG

SEQ ID NO: 263 - protein, 16 aa, Artificial Sequence
  No.44 HC CDR2
NIYYSGSTYYNPSLKS

SEQ ID NO: 264 - protein, 19 aa, Artificial Sequence
  No.44 HC CDR3
GSRGYYDILTGYSTGGFDY

SEQ ID NO: 265 - protein, 11 aa, Artificial Sequence
  No.45 LC CDR1
RASQSISSYLA

SEQ ID NO: 266 - protein, 7 aa, Artificial Sequence
  No.45 LC CDR2
DASNRAT

SEQ ID NO: 267 - protein, 9 aa, Artificial Sequence
  No.45 LC CDR3
QQYGSSPLT

SEQ ID NO: 268 - protein, 7 aa, Artificial Sequence
  No.45 HC CDR1
SSSYYWG

SEQ ID NO: 269 - protein, 16 aa, Artificial Sequence
  No.45 HC CDR2
NIFYSGSTYYNPSLKS

SEQ ID NO: 270 - protein, 19 aa, Artificial Sequence
  No.45 HC CDR3
GSRGYYDILTGYSTGGFDY

SEQ ID NO: 271 - protein, 12 aa, Artificial Sequence
  No.46 LC CDR1
RASQSVSSSYLA

SEQ ID NO: 272 - protein, 7 aa, Artificial Sequence
  No.46 LC CDR2
GASSRAT

SEQ ID NO: 273 - protein, 9 aa, Artificial Sequence
  No.46 LC CDR3
QQYGSSPLT

SEQ ID NO: 274 - protein, 7 aa, Artificial Sequence
  No.46 HC CDR1
SSSYYWG

SEQ ID NO: 275 - protein, 16 aa, Artificial Sequence
  No.46 HC CDR2
NIFYSGSTYYNPSLKS

SEQ ID NO: 276 - protein, 19 aa, Artificial Sequence
  No.46 HC CDR3
GSRGYYDILTGYSTGGFDY

SEQ ID NO: 277 - protein, 12 aa, Artificial Sequence
  No.47 LC CDR1
RASQSVSSSYLA

SEQ ID NO: 278 - protein, 7 aa, Artificial Sequence
  No.47 LC CDR2
DASNRAT

SEQ ID NO: 279 - protein, 9 aa, Artificial Sequence
  No.47 LC CDR3
QQYGSSPLT

SEQ ID NO: 280 - protein, 7 aa, Artificial Sequence
  No.47 HC CDR1
SSSYYWG

SEQ ID NO: 281 - protein, 16 aa, Artificial Sequence
  No.47 HC CDR2
NIFYSGSTYYNPSLKS

SEQ ID NO: 282 - protein, 19 aa, Artificial Sequence
  No.47 HC CDR3
GSRGYYDILTGYSTGGFDY

SEQ ID NO: 283 - protein, 12 aa, Artificial Sequence
  No.48 LC CDR1
RASQSVSSSYLA

SEQ ID NO: 284 - protein, 7 aa, Artificial Sequence
  No.48 LC CDR2
GASSRAT

SEQ ID NO: 285 - protein, 9 aa, Artificial Sequence
  No.48 LC CDR3
QQYGSSPLT

SEQ ID NO: 286 - protein, 5 aa, Artificial Sequence
  No.48 HC CDR1
HYFWS

SEQ ID NO: 287 - protein, 16 aa, Artificial Sequence
  No.48 HC CDR2
NIYYSGSTYYNPSLKS

SEQ ID NO: 288 - protein, 19 aa, Artificial Sequence
  No.48 HC CDR3
GSRGYYDILTGYSTGGFDY

SEQ ID NO: 289 - protein, 14 aa, Artificial Sequence
  No.49 LC CDR1
TGTSSDVGGYNYVS

SEQ ID NO: 290 - protein, 7 aa, Artificial Sequence
  No.49 LC CDR2
DVSNRPS

SEQ ID NO: 291 - protein, 10 aa, Artificial Sequence
  No.49 LC CDR3
SSYTSSSTVV

SEQ ID NO: 292 - protein, 7 aa, Artificial Sequence
  No.49 HC CDR1
SSSYYWG

SEQ ID NO: 293 - protein, 16 aa, Artificial Sequence
  No.49 HC CDR2
NIFYSGSTYYNPSLKS

SEQ ID NO: 294 - protein, 19 aa, Artificial Sequence
  No.49 HC CDR3
GSRGYYDILTGYSTGGFDY

SEQ ID NO: 295 - protein, 11 aa, Artificial Sequence
  No.50 LC CDR1
RASQSISSYLA

SEQ ID NO: 296 - protein, 7 aa, Artificial Sequence
  No.50 LC CDR2
DASNRAT

SEQ ID NO: 297 - protein, 9 aa, Artificial Sequence
  No.50 LC CDR3
QQYGSSPLT

SEQ ID NO: 298 - protein, 7 aa, Artificial Sequence
  No.50 HC CDR1
SSSYYWG

SEQ ID NO: 299 - protein, 16 aa, Artificial Sequence
  No.50 HC CDR2
NIFYSGSTYYNPSLKS

SEQ ID NO: 300 - protein, 19 aa, Artificial Sequence
  No.50 HC CDR3
GSRGYYDILTGYSTGGFDY

SEQ ID NO: 301 - protein, 11 aa, Artificial Sequence
  No.51 LC CDR1
RASQSISSYLA

SEQ ID NO: 302 - protein, 7 aa, Artificial Sequence
  No.51 LC CDR2
DASNRAT

SEQ ID NO: 303 - protein, 9 aa, Artificial Sequence
  No.51 LC CDR3
QQYGSSPLT

SEQ ID NO: 304 - protein, 7 aa, Artificial Sequence
  No.51 HC CDR1
SSSYYWG

SEQ ID NO: 305 - protein, 16 aa, Artificial Sequence
  No.51 HC CDR2
NIFYSGSTYYNPSLKS

SEQ ID NO: 306 - protein, 19 aa, Artificial Sequence
  No.51 HC CDR3
GSRGYYDILTGYSTGGFDY

SEQ ID NO: 307 - protein, 12 aa, Artificial Sequence
  No.52 LC CDR1
RASQSVSSSYLA

SEQ ID NO: 308 - protein, 7 aa, Artificial Sequence
  No.52 LC CDR2
DASNRAT

SEQ ID NO: 309 - protein, 9 aa, Artificial Sequence
  No.52 LC CDR3
QQYGSSPLT

SEQ ID NO: 310 - protein, 7 aa, Artificial Sequence
  No.52 HC CDR1
SSSYYWG

SEQ ID NO: 311 - protein, 16 aa, Artificial Sequence
  No.52 HC CDR2
NIFYSGSTYYNPSLKS

SEQ ID NO: 312 - protein, 19 aa, Artificial Sequence
  No.52 HC CDR3
GSRGYYDILTGYSTGGFDY

SEQ ID NO: 313 - protein, 11 aa, Artificial Sequence
  No.53 LC CDR1
RASQSISSYLA

SEQ ID NO: 314 - protein, 7 aa, Artificial Sequence
  No.53 LC CDR2
GGSSRAT

SEQ ID NO: 315 - protein, 9 aa, Artificial Sequence
  No.53 LC CDR3
QQYGSSPLT

SEQ ID NO: 316 - protein, 7 aa, Artificial Sequence
  No.53 HC CDR1
SSSYYWG

SEQ ID NO: 317 - protein, 16 aa, Artificial Sequence
  No.53 HC CDR2
NIFYSGSTYYNPSLKS

SEQ ID NO: 318 - protein, 19 aa, Artificial Sequence
  No.53 HC CDR3
GSRGYYDILTGYSTGGFDY

SEQ ID NO: 319 - protein, 14 aa, Artificial Sequence
  No.54 LC CDR1
TGTSSDVGGYNYVS

SEQ ID NO: 320 - protein, 7 aa, Artificial Sequence
  No.54 LC CDR2
DVSNRPS

SEQ ID NO: 321 - protein, 10 aa, Artificial Sequence
  No.54 LC CDR3
SSYTSSSTHV

SEQ ID NO: 322 - protein, 7 aa, Artificial Sequence
  No.54 HC CDR1
SSSYYWG

SEQ ID NO: 323 - protein, 16 aa, Artificial Sequence
  No.54 HC CDR2
NIFYSGSTYYNPSLKS

SEQ ID NO: 324 - protein, 19 aa, Artificial Sequence
  No.54 HC CDR3
GSRGYYDILTGYSTGGFDY

SEQ ID NO: 325 - protein, 11 aa, Artificial Sequence
  No.55 LC CDR1
RASQSVSTYLA

SEQ ID NO: 326 - protein, 7 aa, Artificial Sequence
  No.55 LC CDR2
DASNRAT

SEQ ID NO: 327 - protein, 10 aa, Artificial Sequence
  No.55 LC CDR3
QQYGSSPSIT

SEQ ID NO: 328 - protein, 7 aa, Artificial Sequence
  No.55 HC CDR1
SSSYYWG

SEQ ID NO: 329 - protein, 16 aa, Artificial Sequence
  No.55 HC CDR2
NIFYSGSTYYNPSLKS

SEQ ID NO: 330 - protein, 19 aa, Artificial Sequence
  No.55 HC CDR3
GSRGYYDILTGYSTGGFDY

SEQ ID NO: 331 - protein, 12 aa, Artificial Sequence
  No.56 LC CDR1
RASQSVSSSYLA

SEQ ID NO: 332 - protein, 7 aa, Artificial Sequence
  No.56 LC CDR2
GASSRAT

SEQ ID NO: 333 - protein, 11 aa, Artificial Sequence
  No.56 LC CDR3
QEYGSSPGRVT

SEQ ID NO: 334 - protein, 7 aa, Artificial Sequence
  No.56 HC CDR1
SSSYYWG

SEQ ID NO: 335 - protein, 16 aa, Artificial Sequence
  No.56 HC CDR2
NIFYSGSTYYNPSLKS

SEQ ID NO: 336 - protein, 19 aa, Artificial Sequence
  No.56 HC CDR3
GSRGYYDILTGYSTGGFDY

SEQ ID NO: 337 - protein, 12 aa, Artificial Sequence
  No.57 LC CDR1
RASQSVSSSYLA

SEQ ID NO: 338 - protein, 7 aa, Artificial Sequence
  No.57 LC CDR2
GASSRAT

SEQ ID NO: 339 - protein, 9 aa, Artificial Sequence
  No.57 LC CDR3
QQYGSSPLT

SEQ ID NO: 340 - protein, 7 aa, Artificial Sequence
  No.57 HC CDR1
SSSYYWG

SEQ ID NO: 341 - protein, 16 aa, Artificial Sequence
  No.57 HC CDR2
NIFYSGSTYYNPSLKS

SEQ ID NO: 342 - protein, 19 aa, Artificial Sequence
  No.57 HC CDR3
GSRGYYDILTGYSTGGFDY

SEQ ID NO: 343 - protein, 12 aa, Artificial Sequence
  No.58 LC CDR1
RASQSVSSSYLA

SEQ ID NO: 344 - protein, 7 aa, Artificial Sequence
  No.58 LC CDR2
GASSRAT

SEQ ID NO: 345 - protein, 9 aa, Artificial Sequence
  No.58 LC CDR3
QQYGSSPLT

SEQ ID NO: 346 - protein, 7 aa, Artificial Sequence
  No.58 HC CDR1
SSSYYWG

SEQ ID NO: 347 - protein, 16 aa, Artificial Sequence
  No.58 HC CDR2
NIFYSGSTYYNPSLKS

SEQ ID NO: 348 - protein, 19 aa, Artificial Sequence
  No.58 HC CDR3
GSRGYYDILTGYSTGGFDY

SEQ ID NO: 349 - protein, 12 aa, Artificial Sequence
  No.59 LC CDR1
RASQSVSSSYLA

SEQ ID NO: 350 - protein, 7 aa, Artificial Sequence
  No.59 LC CDR2
GASSRAT

SEQ ID NO: 351 - protein, 9 aa, Artificial Sequence
  No.59 LC CDR3
QQYGSSPLT

SEQ ID NO: 352 - protein, 7 aa, Artificial Sequence
  No.59 HC CDR1
SSSYYWG

SEQ ID NO: 353 - protein, 16 aa, Artificial Sequence
  No.59 HC CDR2
NIFYSGSTYYNPSLKS

SEQ ID NO: 354 - protein, 19 aa, Artificial Sequence
  No.59 HC CDR3
GSRGYYDILTGYSTGGFDY

SEQ ID NO: 355 - protein, 12 aa, Artificial Sequence
  No.60 LC CDR1
RASQSVSSSYLA

SEQ ID NO: 356 - protein, 7 aa, Artificial Sequence
  No.60 LC CDR2
GASSRAT

SEQ ID NO: 357 - protein, 9 aa, Artificial Sequence
  No.60 LC CDR3
QQYGSSPLT

SEQ ID NO: 358 - protein, 7 aa, Artificial Sequence
  No.60 HC CDR1
SSSYYWG

SEQ ID NO: 359 - protein, 16 aa, Artificial Sequence
  No.60 HC CDR2
NIFYSGSTYYNPSLKS

SEQ ID NO: 360 - protein, 19 aa, Artificial Sequence
  No.60 HC CDR3
GSRGYYDILTGYSTGGFDY

SEQ ID NO: 361 - protein, 11 aa, Artificial Sequence
  No.61 LC CDR1
RASQSVSSYLA

SEQ ID NO: 362 - protein, 7 aa, Artificial Sequence
  No.61 LC CDR2
DASNRAT

SEQ ID NO: 363 - protein, 10 aa, Artificial Sequence
  No.61 LC CDR3
QQYYSTPSIT

SEQ ID NO: 364 - protein, 7 aa, Artificial Sequence
  No.61 HC CDR1
SSSYYWG

SEQ ID NO: 365 - protein, 16 aa, Artificial Sequence
  No.61 HC CDR2
NIFYSGSTYYNPSLKS

SEQ ID NO: 366 - protein, 19 aa, Artificial Sequence
  No.61 HC CDR3
GSRGYYDILTGYSTGGFDY

SEQ ID NO: 367 - protein, 12 aa, Artificial Sequence
  No.62 LC CDR1
RASQSVSSSYLA

SEQ ID NO: 368 - protein, 7 aa, Artificial Sequence
  No.62 LC CDR2
DASNRAT

SEQ ID NO: 369 - protein, 9 aa, Artificial Sequence
  No.62 LC CDR3
QQYGSSPLT

SEQ ID NO: 370 - protein, 7 aa, Artificial Sequence
  No.62 HC CDR1
SSSYYWG

SEQ ID NO: 371 - protein, 16 aa, Artificial Sequence
  No.62 HC CDR2
NIFYSGSTYYNPSLKS

SEQ ID NO: 372 - protein, 19 aa, Artificial Sequence
  No.62 HC CDR3
GSRGYYDILTGYSTGGFDY

SEQ ID NO: 373 - protein, 14 aa, Artificial Sequence
  No.63 LC CDR1
TGTSSDVGGYNYVS

SEQ ID NO: 374 - protein, 7 aa, Artificial Sequence
  No.63 LC CDR2
DVSNRPS

SEQ ID NO: 375 - protein, 10 aa, Artificial Sequence
  No.63 LC CDR3
SSYTSSSTWV

SEQ ID NO: 376 - protein, 7 aa, Artificial Sequence
  No.63 HC CDR1
SSSYYWG

SEQ ID NO: 377 - protein, 16 aa, Artificial Sequence
  No.63 HC CDR2
NIFYSGSTYYNPSLKS

SEQ ID NO: 378 - protein, 19 aa, Artificial Sequence
  No.63 HC CDR3
GSRGYYDILTGYSTGGFDY

SEQ ID NO: 379 - protein, 12 aa, Artificial Sequence
  No.64 LC CDR1
RASQSVSSSYLA

SEQ ID NO: 380 - protein, 7 aa, Artificial Sequence
  No.64 LC CDR2
GASSRAT

SEQ ID NO: 381 - protein, 9 aa, Artificial Sequence
  No.64 LC CDR3
QQYGSSPLT

SEQ ID NO: 382 - protein, 7 aa, Artificial Sequence
  No.64 HC CDR1
SSSYYWG

SEQ ID NO: 383 - protein, 16 aa, Artificial Sequence
  No.64 HC CDR2
NIFYSGSTYYNPSLKS

SEQ ID NO: 384 - protein, 19 aa, Artificial Sequence
  No.64 HC CDR3
GSRGYYDILTGYSTGGFDY

SEQ ID NO: 385 - protein, 12 aa, Artificial Sequence
  No.65 LC CDR1
RASQSVSSSFLA

SEQ ID NO: 386 - protein, 7 aa, Artificial Sequence
  No.65 LC CDR2
GASSRAT

SEQ ID NO: 387 - protein, 11 aa, Artificial Sequence
  No.65 LC CDR3
QEYGSSPGRVT

SEQ ID NO: 388 - protein, 7 aa, Artificial Sequence
  No.65 HC CDR1
SSSYYWG

SEQ ID NO: 389 - protein, 16 aa, Artificial Sequence
  No.65 HC CDR2
NIFYSGSTYYNPSLKS

SEQ ID NO: 390 - protein, 19 aa, Artificial Sequence
  No.65 HC CDR3
GSRGYYDILTGYSTGGFDY

SEQ ID NO: 391 - protein, 11 aa, Artificial Sequence
  No.66 LC CDR1
RASQSVSNYLA

SEQ ID NO: 392 - protein, 7 aa, Artificial Sequence
  No.66 LC CDR2
DASNRAT

SEQ ID NO: 393 - protein, 9 aa, Artificial Sequence
  No.66 LC CDR3
QQYGSSPLT

SEQ ID NO: 394 - protein, 7 aa, Artificial Sequence
  No.66 HC CDR1
SSSYYWG

SEQ ID NO: 395 - protein, 16 aa, Artificial Sequence
  No.66 HC CDR2
NIFYSGSTYYNPSLKS

SEQ ID NO: 396 - protein, 19 aa, Artificial Sequence
  No.66 HC CDR3
GSRGYYDILTGYSTGGFDY

SEQ ID NO: 397 - protein, 11 aa, Artificial Sequence
  No.67 LC CDR1
RASQSVSNYLA

SEQ ID NO: 398 - protein, 7 aa, Artificial Sequence
  No.67 LC CDR2
DASNRAT

SEQ ID NO: 399 - protein, 9 aa, Artificial Sequence
  No.67 LC CDR3
QQYGSSPLT

SEQ ID NO: 400 - protein, 7 aa, Artificial Sequence
  No.67 HC CDR1
SSSYYWG

SEQ ID NO: 401 - protein, 16 aa, Artificial Sequence
  No.67 HC CDR2
NIFYSGSTYYNPSLKS

SEQ ID NO: 402 - protein, 19 aa, Artificial Sequence
  No.67 HC CDR3
GSRGYYDILTGYSTGGFDY

SEQ ID NO: 403 - protein, 12 aa, Artificial Sequence
  No.68 LC CDR1
RASQSVSSSYLA

SEQ ID NO: 404 - protein, 7 aa, Artificial Sequence
  No.68 LC CDR2
GASSRAT

SEQ ID NO: 405 - protein, 11 aa, Artificial Sequence
  No.68 LC CDR3
QEYGSSPGRVT

SEQ ID NO: 406 - protein, 7 aa, Artificial Sequence
  No.68 HC CDR1
SSSYYWG

SEQ ID NO: 407 - protein, 16 aa, Artificial Sequence
  No.68 HC CDR2
NIFYSGSTYYNPSLKS

SEQ ID NO: 408 - protein, 19 aa, Artificial Sequence
  No.68 HC CDR3
GSRGYYDILTGYSTGGFDY

SEQ ID NO: 409 - protein, 12 aa, Artificial Sequence
  No.69 LC CDR1
RASQSVRSSYLA

SEQ ID NO: 410 - protein, 7 aa, Artificial Sequence
  No.69 LC CDR2
AASTRAT

SEQ ID NO: 411 - protein, 10 aa, Artificial Sequence
  No.69 LC CDR3
QQYGDSLSIT

SEQ ID NO: 412 - protein, 7 aa, Artificial Sequence
  No.69 HC CDR1
SSSYYWG

SEQ ID NO: 413 - protein, 16 aa, Artificial Sequence
  No.69 HC CDR2
NIFYSGSTYYNPSLKS

SEQ ID NO: 414 - protein, 19 aa, Artificial Sequence
  No.69 HC CDR3
GSRGYYDILTGYSTGGFDY

SEQ ID NO: 415 - protein, 11 aa, Artificial Sequence
  No.70 LC CDR1
RASQSVSSYLA

SEQ ID NO: 416 - protein, 7 aa, Artificial Sequence
  No.70 LC CDR2
DASNRAT

SEQ ID NO: 417 - protein, 10 aa, Artificial Sequence
  No.70 LC CDR3
QQYGSSPSIT

SEQ ID NO: 418 - protein, 7 aa, Artificial Sequence
  No.70 HC CDR1
SSSYYWG

SEQ ID NO: 419 - protein, 16 aa, Artificial Sequence
  No.70 HC CDR2
NIFYSGSTYYNPSLKS

SEQ ID NO: 420 - protein, 19 aa, Artificial Sequence
  No.70 HC CDR3
GSRGYYDILTGYSTGGFDY

SEQ ID NO: 421 - protein, 11 aa, Artificial Sequence
  No.71 LC CDR1
RASQSVSSNLA

SEQ ID NO: 422 - protein, 7 aa, Artificial Sequence
  No.71 LC CDR2
DASTRAT

SEQ ID NO: 423 - protein, 9 aa, Artificial Sequence
  No.71 LC CDR3
QQYNNWPLT

SEQ ID NO: 424 - protein, 7 aa, Artificial Sequence
  No.71 HC CDR1
SSSYYWG

SEQ ID NO: 425 - protein, 16 aa, Artificial Sequence
  No.71 HC CDR2
NIFYSGSTYYNPSLKS

SEQ ID NO: 426 - protein, 19 aa, Artificial Sequence
  No.71 HC CDR3
GSRGYYDILTGYSTGGFDY

SEQ ID NO: 427 - protein, 13 aa, Artificial Sequence
  No.72 LC CDR1
SGSSSNIGSNYVS

SEQ ID NO: 428 - protein, 7 aa, Artificial Sequence
  No.72 LC CDR2
DVSNRPS

SEQ ID NO: 429 - protein, 10 aa, Artificial Sequence
  No.72 LC CDR3
SSYTSSSTLP

SEQ ID NO: 430 - protein, 7 aa, Artificial Sequence
  No.72 HC CDR1
SSSYYWG

SEQ ID NO: 431 - protein, 16 aa, Artificial Sequence
  No.72 HC CDR2
NIFYSGSTYYNPSLKS

SEQ ID NO: 432 - protein, 19 aa, Artificial Sequence
  No.72 HC CDR3
GSRGYYDILTGYSTGGFDY

SEQ ID NO: 433 - protein, 12 aa, Artificial Sequence
  No.73 LC CDR1
RASQSVSSSFLA

SEQ ID NO: 434 - protein, 7 aa, Artificial Sequence
  No.73 LC CDR2
GASSRAT

SEQ ID NO: 435 - protein, 11 aa, Artificial Sequence
  No.73 LC CDR3
QEYGSSPGRVT

SEQ ID NO: 436 - protein, 7 aa, Artificial Sequence
  No.73 HC CDR1
SSSYYWG

SEQ ID NO: 437 - protein, 16 aa, Artificial Sequence
  No.73 HC CDR2
NIFYSGSTYYNPSLKS

SEQ ID NO: 438 - protein, 19 aa, Artificial Sequence
  No.73 HC CDR3
GSRGYYDILTGYSTGGFDY

SEQ ID NO: 439 - protein, 11 aa, Artificial Sequence
  No.74 LC CDR1
RASQSVSNYLA

SEQ ID NO: 440 - protein, 7 aa, Artificial Sequence
  No.74 LC CDR2
DASNRAT

SEQ ID NO: 441 - protein, 9 aa, Artificial Sequence
  No.74 LC CDR3
QQYGSSPLT

SEQ ID NO: 442 - protein, 7 aa, Artificial Sequence
  No.74 HC CDR1
SSSYYWG

SEQ ID NO: 443 - protein, 16 aa, Artificial Sequence
  No.74 HC CDR2
NIFYSGSTYYNPSLKS

SEQ ID NO: 444 - protein, 19 aa, Artificial Sequence
  No.74 HC CDR3
GSRGYYDILTGYSTGGFDY

SEQ ID NO: 445 - protein, 12 aa, Artificial Sequence
  No.75 LC CDR1
RASQSVSSSYLA

SEQ ID NO: 446 - protein, 7 aa, Artificial Sequence
  No.75 LC CDR2
GASSRAT

SEQ ID NO: 447 - protein, 9 aa, Artificial Sequence
  No.75 LC CDR3
QQYGSSPLT

SEQ ID NO: 448 - protein, 7 aa, Artificial Sequence
  No.75 HC CDR1
SSSYYWG

SEQ ID NO: 449 - protein, 16 aa, Artificial Sequence
  No.75 HC CDR2
NIFYSGSTYYNPSLKS

SEQ ID NO: 450 - protein, 19 aa, Artificial Sequence
  No.75 HC CDR3
GSRGYYDILTGYSTGGFDY

SEQ ID NO: 451 - protein, 12 aa, Artificial Sequence
  No.76 LC CDR1
RASQSVSSSYLA

SEQ ID NO: 452 - protein, 7 aa, Artificial Sequence
  No.76 LC CDR2
DASNRAT

SEQ ID NO: 453 - protein, 9 aa, Artificial Sequence
  No.76 LC CDR3
QQYGSSPLT

SEQ ID NO: 454 - protein, 7 aa, Artificial Sequence
  No.76 HC CDR1
SSSYYWG

SEQ ID NO: 455 - protein, 16 aa, Artificial Sequence
  No.76 HC CDR2
NIFYSGSTYYNPSLKS

SEQ ID NO: 456 - protein, 19 aa, Artificial Sequence
  No.76 HC CDR3
GSRGYYDILTGYSTGGFDY

SEQ ID NO: 457 - protein, 11 aa, Artificial Sequence
  No.77 LC CDR1
RASQSVSSNLA

SEQ ID NO: 458 - protein, 7 aa, Artificial Sequence
  No.77 LC CDR2
DASTRAT

SEQ ID NO: 459 - protein, 9 aa, Artificial Sequence
  No.77 LC CDR3
QQYNNWPLT

SEQ ID NO: 460 - protein, 7 aa, Artificial Sequence
  No.77 HC CDR1
SSSYYWG

SEQ ID NO: 461 - protein, 16 aa, Artificial Sequence
  No.77 HC CDR2
NIFYSGSTYYNPSLKS

SEQ ID NO: 462 - protein, 19 aa, Artificial Sequence
  No.77 HC CDR3
GSRGYYDILTGYSTGGFDY

SEQ ID NO: 463 - protein, 12 aa, Artificial Sequence
  No.78 LC CDR1
RASQSVSSSYLA

SEQ ID NO: 464 - protein, 7 aa, Artificial Sequence
  No.78 LC CDR2
DASNRAT

SEQ ID NO: 465 - protein, 9 aa, Artificial Sequence
  No.78 LC CDR3
QQYGSSPLT

SEQ ID NO: 466 - protein, 7 aa, Artificial Sequence
  No.78 HC CDR1
SSSYYWG

SEQ ID NO: 467 - protein, 16 aa, Artificial Sequence
  No.78 HC CDR2
NIFYSGSTYYNPSLKS

SEQ ID NO: 468 - protein, 19 aa, Artificial Sequence
  No.78 HC CDR3
GSRGYYDILTGYSTGGFDY

SEQ ID NO: 469 - protein, 11 aa, Artificial Sequence
  No.79 LC CDR1
RASQSVSSYLA

SEQ ID NO: 470 - protein, 7 aa, Artificial Sequence
  No.79 LC CDR2
DASNRAT

SEQ ID NO: 471 - protein, 10 aa, Artificial Sequence
  No.79 LC CDR3
QQYYSTPSIT

SEQ ID NO: 472 - protein, 7 aa, Artificial Sequence
  No.79 HC CDR1
SSSYYWG

SEQ ID NO: 473 - protein, 16 aa, Artificial Sequence
  No.79 HC CDR2
NIFYSGSTYYNPSLKS

SEQ ID NO: 474 - protein, 19 aa, Artificial Sequence
  No.79 HC CDR3
GSRGYYDILTGYSTGGFDY

SEQ ID NO: 475 - protein, 11 aa, Artificial Sequence
  No.80 LC CDR1
RASQSVSNYLA

SEQ ID NO: 476 - protein, 7 aa, Artificial Sequence
  No.80 LC CDR2
DASNRAT

SEQ ID NO: 477 - protein, 9 aa, Artificial Sequence
  No.80 LC CDR3
QQYGSSPLT

SEQ ID NO: 478 - protein, 7 aa, Artificial Sequence
  No.80 HC CDR1
SSSYYWG

SEQ ID NO: 479 - protein, 16 aa, Artificial Sequence
  No.80 HC CDR2
NIFYSGSTYYNPSLKS

SEQ ID NO: 480 - protein, 19 aa, Artificial Sequence
  No.80 HC CDR3
GSRGYYDILTGYSTGGFDY

SEQ ID NO: 481 - protein, 11 aa, Artificial Sequence
  No.81 LC CDR1
RASQSVSSYLA

SEQ ID NO: 482 - protein, 7 aa, Artificial Sequence
  No.81 LC CDR2
DASNRAT

SEQ ID NO: 483 - protein, 9 aa, Artificial Sequence
  No.81 LC CDR3
QQYGSSPLT

SEQ ID NO: 484 - protein, 7 aa, Artificial Sequence
  No.81 HC CDR1
SSSYYWG

SEQ ID NO: 485 - protein, 16 aa, Artificial Sequence
  No.81 HC CDR2
NIFYSGSTYYNPSLKS

SEQ ID NO: 486 - protein, 19 aa, Artificial Sequence
  No.81 HC CDR3
GSRGYYDILTGYSTGGFDY

SEQ ID NO: 487 - protein, 11 aa, Artificial Sequence
  No.82 LC CDR1
RASQSVSSYLA

SEQ ID NO: 488 - protein, 7 aa, Artificial Sequence
  No.82 LC CDR2
DASNRAT

SEQ ID NO: 489 - protein, 9 aa, Artificial Sequence
  No.82 LC CDR3
QQYGSSPLT

SEQ ID NO: 490 - protein, 7 aa, Artificial Sequence
  No.82 HC CDR1
SSSYYWG

SEQ ID NO: 491 - protein, 16 aa, Artificial Sequence
  No.82 HC CDR2
NIFYSGSTYYNPSLKS

SEQ ID NO: 492 - protein, 19 aa, Artificial Sequence
  No.82 HC CDR3
GSRGYYDILTGYSTGGFDY

SEQ ID NO: 493 - protein, 11 aa, Artificial Sequence
  No.83 LC CDR1
RASQSVSSNLA

SEQ ID NO: 494 - protein, 7 aa, Artificial Sequence
  No.83 LC CDR2
GASTRAT

SEQ ID NO: 495 - protein, 9 aa, Artificial Sequence
  No.83 LC CDR3
QQYNNWPLT

SEQ ID NO: 496 - protein, 7 aa, Artificial Sequence
  No.83 HC CDR1
GSSYYWG

SEQ ID NO: 497 - protein, 16 aa, Artificial Sequence
  No.83 HC CDR2
NIFYSGSTYYNPSLKS

SEQ ID NO: 498 - protein, 19 aa, Artificial Sequence
  No.83 HC CDR3
GSRGYYDILTGYSTGGFDY

SEQ ID NO: 499 - protein, 14 aa, Artificial Sequence
  No.84 LC CDR1
TGTSSDVGGYNYVS

SEQ ID NO: 500 - protein, 7 aa, Artificial Sequence
  No.84 LC CDR2
DVSNRPS

SEQ ID NO: 501 - protein, 10 aa, Artificial Sequence
  No.84 LC CDR3
SSYTSSSTWV

SEQ ID NO: 502 - protein, 7 aa, Artificial Sequence
  No.84 HC CDR1
SSSYYWG

SEQ ID NO: 503 - protein, 16 aa, Artificial Sequence
  No.84 HC CDR2
NIFYSGSTYYNPSLKS

SEQ ID NO: 504 - protein, 19 aa, Artificial Sequence
  No.84 HC CDR3
GSRGYYDILTGYSTGGFDY

SEQ ID NO: 505 - protein, 11 aa, Artificial Sequence
  No.85 LC CDR1
RASQSISSYLA

SEQ ID NO: 506 - protein, 7 aa, Artificial Sequence
  No.85 LC CDR2
DASNRAT

SEQ ID NO: 507 - protein, 9 aa, Artificial Sequence
  No.85 LC CDR3
QQYGSSPLT

SEQ ID NO: 508 - protein, 7 aa, Artificial Sequence
  No.85 HC CDR1
SSSYYWG

SEQ ID NO: 509 - protein, 16 aa, Artificial Sequence
  No.85 HC CDR2
NIFYSGSTYYNPSLKS

SEQ ID NO: 510 - protein, 19 aa, Artificial Sequence
  No.85 HC CDR3
GSRGYYDILTGYSTGGFDY

SEQ ID NO: 511 - protein, 11 aa, Artificial Sequence
  No.86 LC CDR1
RASQSVSSYLA

SEQ ID NO: 512 - protein, 7 aa, Artificial Sequence
  No.86 LC CDR2
DASSRAT

SEQ ID NO: 513 - protein, 9 aa, Artificial Sequence
  No.86 LC CDR3
QQYGSSPYT

SEQ ID NO: 514 - protein, 7 aa, Artificial Sequence
  No.86 HC CDR1
SSSYYWG

SEQ ID NO: 515 - protein, 16 aa, Artificial Sequence
  No.86 HC CDR2
NIFYSGSTYYNPSLKS

SEQ ID NO: 516 - protein, 19 aa, Artificial Sequence
  No.86 HC CDR3
GSRGYYDILTGYSTGGFDY

SEQ ID NO: 517 - protein, 11 aa, Artificial Sequence
  No.87 LC CDR1
RASQSVSNYLA

SEQ ID NO: 518 - protein, 7 aa, Artificial Sequence
  No.87 LC CDR2
DASNRAT

SEQ ID NO: 519 - protein, 9 aa, Artificial Sequence
  No.87 LC CDR3
QQYGSSPLT

SEQ ID NO: 520 - protein, 7 aa, Artificial Sequence
  No.87 HC CDR1
SSSYYWG

SEQ ID NO: 521 - protein, 16 aa, Artificial Sequence
  No.87 HC CDR2
NIFYSGSTYYNPSLKS

SEQ ID NO: 522 - protein, 19 aa, Artificial Sequence
  No.87 HC CDR3
GSRGYYDILTGYSTGGFDY

SEQ ID NO: 523 - protein, 11 aa, Artificial Sequence
  No.88 LC CDR1
RASQSVSSYLA

SEQ ID NO: 524 - protein, 7 aa, Artificial Sequence
  No.88 LC CDR2
DASNRAT

SEQ ID NO: 525 - protein, 10 aa, Artificial Sequence
  No.88 LC CDR3
QQYGSSPSIT

SEQ ID NO: 526 - protein, 7 aa, Artificial Sequence
  No.88 HC CDR1
SSSYYWG

SEQ ID NO: 527 - protein, 16 aa, Artificial Sequence
  No.88 HC CDR2
SIYYSGSTYYNPSLKS

SEQ ID NO: 528 - protein, 19 aa, Artificial Sequence
  No.88 HC CDR3
GSRGYYDFLTGYSTGGFDY

SEQ ID NO: 529 - protein, 13 aa, Artificial Sequence
  No.89 LC CDR1
SGSSSNIGDNYVS

SEQ ID NO: 530 - protein, 7 aa, Artificial Sequence
  No.89 LC CDR2
DNDKRPS

SEQ ID NO: 531 - protein, 11 aa, Artificial Sequence
  No.89 LC CDR3
GTWDSSLSAVV

SEQ ID NO: 532 - protein, 7 aa, Artificial Sequence
  No.89 HC CDR1
TSGMGVG

SEQ ID NO: 533 - protein, 16 aa, Artificial Sequence
  No.89 HC CDR2
LIDWDDNKYYTTSLKT

SEQ ID NO: 534 - protein, 18 aa, Artificial Sequence
  No.89 HC CDR3
IPGFLRYRNRYYYYGMDV

SEQ ID NO: 535 - protein, 13 aa, Artificial Sequence
  No.90 LC CDR1
SGSSSNIGNNYVS

SEQ ID NO: 536 - protein, 7 aa, Artificial Sequence
  No.90 LC CDR2
DNNKRPS

SEQ ID NO: 537 - protein, 11 aa, Artificial Sequence
  No.90 LC CDR3
GTWDSSLSAGV

SEQ ID NO: 538 - protein, 7 aa, Artificial Sequence
  No.90 HC CDR1
TSGMGVG

SEQ ID NO: 539 - protein, 16 aa, Artificial Sequence
  No.90 HC CDR2
LIDWDDNKYYTTSLKT

SEQ ID NO: 540 - protein, 18 aa, Artificial Sequence
  No.90 HC CDR3
IPGFLRYRNRYYYYGMDV

SEQ ID NO: 541 - protein, 13 aa, Artificial Sequence
  No.91 LC CDR1
SGSSSNIGNNYVS

SEQ ID NO: 542 - protein, 7 aa, Artificial Sequence
  No.91 LC CDR2
DNNKRPS

SEQ ID NO: 543 - protein, 11 aa, Artificial Sequence
  No.91 LC CDR3
GTWDNSLSAGV

SEQ ID NO: 544 - protein, 7 aa, Artificial Sequence
  No.91 HC CDR1
TSGVGVG

SEQ ID NO: 545 - protein, 16 aa, Artificial Sequence
  No.91 HC CDR2
LIDWDDNKYYTTSLKT

SEQ ID NO: 546 - protein, 18 aa, Artificial Sequence
  No.91 HC CDR3
IPGFLRYRNRYYYYGMDV

SEQ ID NO: 547 - protein, 13 aa, Artificial Sequence
  No.92 LC CDR1
SGSSSNIGNNYVS

SEQ ID NO: 548 - protein, 7 aa, Artificial Sequence
  No.92 LC CDR2
DNNKRPS

SEQ ID NO: 549 - protein, 11 aa, Artificial Sequence
  No.92 LC CDR3
GTWDSSLSAGV

SEQ ID NO: 550 - protein, 7 aa, Artificial Sequence
  No.92 HC CDR1
TSGMGVG

SEQ ID NO: 551 - protein, 16 aa, Artificial Sequence
  No.92 HC CDR2
LIDWDDNKYYTTSLKT

SEQ ID NO: 552 - protein, 18 aa, Artificial Sequence
  No.92 HC CDR3
IPGFLRYRNRYYYYGMDV

SEQ ID NO: 553 - protein, 13 aa, Artificial Sequence
  No.93 LC CDR1
SGSSSNIGNNYVS

SEQ ID NO: 554 - protein, 7 aa, Artificial Sequence
  No.93 LC CDR2
DNNKRPS

SEQ ID NO: 555 - protein, 11 aa, Artificial Sequence
  No.93 LC CDR3
GTWDSSLSAGR

SEQ ID NO: 556 - protein, 7 aa, Artificial Sequence
  No.93 HC CDR1
TSGVGVG

SEQ ID NO: 557 - protein, 16 aa, Artificial Sequence
  No.93 HC CDR2
LIDWDDNKYYTTSLKT

SEQ ID NO: 558 - protein, 18 aa, Artificial Sequence
  No.93 HC CDR3
IPGFLRYRNRYYYYGMDV

SEQ ID NO: 559 - protein, 13 aa, Artificial Sequence
  No.94 LC CDR1
SGSSSNIGNNYVS

SEQ ID NO: 560 - protein, 7 aa, Artificial Sequence
  No.94 LC CDR2
DNNKRPS

SEQ ID NO: 561 - protein, 11 aa, Artificial Sequence
  No.94 LC CDR3
GTWDSSLSAGV

SEQ ID NO: 562 - protein, 7 aa, Artificial Sequence
  No.94 HC CDR1
TSGMGVG

SEQ ID NO: 563 - protein, 16 aa, Artificial Sequence
  No.94 HC CDR2
LIDWDDNKYYTTSLKT

SEQ ID NO: 564 - protein, 18 aa, Artificial Sequence
  No.94 HC CDR3
IPGFLRYRNRYYYYGMDV

SEQ ID NO: 565 - protein, 13 aa, Artificial Sequence
  No.95 LC CDR1
SGSSSNIGNNYVS

SEQ ID NO: 566 - protein, 7 aa, Artificial Sequence
  No.95 LC CDR2
DNNKRPS

SEQ ID NO: 567 - protein, 11 aa, Artificial Sequence
  No.95 LC CDR3
GTWDSSLSAGV

SEQ ID NO: 568 - protein, 7 aa, Artificial Sequence
  No.95 HC CDR1
TSGVGVG

SEQ ID NO: 569 - protein, 16 aa, Artificial Sequence
  No.95 HC CDR2
LIDWDDNKYYTTSLKT

SEQ ID NO: 570 - protein, 18 aa, Artificial Sequence
  No.95 HC CDR3
IPGFLRYRNRYYYYGMDV

SEQ ID NO: 571 - protein, 13 aa, Artificial Sequence
  No.96 LC CDR1
SGSSSNIGNNYVS

SEQ ID NO: 572 - protein, 7 aa, Artificial Sequence
  No.96 LC CDR2
DNNKRPS

SEQ ID NO: 573 - protein, 11 aa, Artificial Sequence
  No.96 LC CDR3
GTWDSSLSAGV

SEQ ID NO: 574 - protein, 7 aa, Artificial Sequence
  No.96 HC CDR1
TSGMGVG

SEQ ID NO: 575 - protein, 16 aa, Artificial Sequence
  No.96 HC CDR2
LIDWDDNKYYTTSLKT

SEQ ID NO: 576 - protein, 18 aa, Artificial Sequence
  No.96 HC CDR3
IPGFLRYRNRYYYYGMDV

SEQ ID NO: 577 - protein, 13 aa, Artificial Sequence
  No.97 LC CDR1
SGSSSNIGNNYVS

SEQ ID NO: 578 - protein, 7 aa, Artificial Sequence
  No.97 LC CDR2
DNNKRPS

SEQ ID NO: 579 - protein, 11 aa, Artificial Sequence
  No.97 LC CDR3
GTWDSSLSAGV

SEQ ID NO: 580 - protein, 7 aa, Artificial Sequence
  No.97 HC CDR1
TSGMGVS

SEQ ID NO: 581 - protein, 16 aa, Artificial Sequence
  No.97 HC CDR2
LIDWDDNKYYTTSLKT

SEQ ID NO: 582 - protein, 18 aa, Artificial Sequence
  No.97 HC CDR3
IPGFLRYRNRYYYYGMDV

SEQ ID NO: 583 - protein, 13 aa, Artificial Sequence
  No.98 LC CDR1
SGSSSNIGNNYVS

SEQ ID NO: 584 - protein, 7 aa, Artificial Sequence
  No.98 LC CDR2
DNNKRPS

SEQ ID NO: 585 - protein, 11 aa, Artificial Sequence
  No.98 LC CDR3
GTWDSSLSAGV

SEQ ID NO: 586 - protein, 7 aa, Artificial Sequence
  No.98 HC CDR1
TSGMGVG

SEQ ID NO: 587 - protein, 16 aa, Artificial Sequence
  No.98 HC CDR2
LIDWDDNKYYTTSLKT

SEQ ID NO: 588 - protein, 18 aa, Artificial Sequence
  No.98 HC CDR3
IPGFLRYRNRYYYYGMDV

SEQ ID NO: 589 - protein, 13 aa, Artificial Sequence
  No.99 LC CDR1
SGSSSNIGNNYVS

SEQ ID NO: 590 - protein, 7 aa, Artificial Sequence
  No.99 LC CDR2
DNNKRPS

SEQ ID NO: 591 - protein, 11 aa, Artificial Sequence
  No.99 LC CDR3
GTWDSSLSAGV

SEQ ID NO: 592 - protein, 7 aa, Artificial Sequence
  No.99 HC CDR1
TSGMGVG

SEQ ID NO: 593 - protein, 16 aa, Artificial Sequence
  No.99 HC CDR2
LIDWDDNKYYTTSLKT

SEQ ID NO: 594 - protein, 18 aa, Artificial Sequence
  No.99 HC CDR3
IPGFLRYRNRYYYYGMDV

SEQ ID NO: 595 - protein, 13 aa, Artificial Sequence
  No.100 LC CDR1
SGSSSNIGNNYVS

SEQ ID NO: 596 - protein, 7 aa, Artificial Sequence
  No.100 LC CDR2
DNNKRPS

SEQ ID NO: 597 - protein, 11 aa, Artificial Sequence
  No.100 LC CDR3
GTWDSSLSAGV

SEQ ID NO: 598 - protein, 7 aa, Artificial Sequence
  No.100 HC CDR1
TSGMGVG

SEQ ID NO: 599 - protein, 16 aa, Artificial Sequence
  No.100 HC CDR2
LIDWDDNKYYTTSLKT

SEQ ID NO: 600 - protein, 18 aa, Artificial Sequence
  No.100 HC CDR3
IPGFLRYRNRYYYYGMDV

SEQ ID NO: 601 - protein, 13 aa, Artificial Sequence
  No.101 LC CDR1
SGSSSNIGNNYVS

SEQ ID NO: 602 - protein, 7 aa, Artificial Sequence
  No.101 LC CDR2
DNNKRPS

SEQ ID NO: 603 - protein, 11 aa, Artificial Sequence
  No.101 LC CDR3
GTWDSSLSAGV

SEQ ID NO: 604 - protein, 7 aa, Artificial Sequence
  No.101 HC CDR1
TSGMGVG

SEQ ID NO: 605 - protein, 16 aa, Artificial Sequence
  No.101 HC CDR2
LIDWDDNKYYTTSLKT

SEQ ID NO: 606 - protein, 18 aa, Artificial Sequence
  No.101 HC CDR3
IPGFLRYRNRYYYYGMDV

SEQ ID NO: 607 - protein, 13 aa, Artificial Sequence
  No.102 LC CDR1
SGSSSNIGNNYVS

SEQ ID NO: 608 - protein, 7 aa, Artificial Sequence
  No.102 LC CDR2
DNNKRPS

SEQ ID NO: 609 - protein, 11 aa, Artificial Sequence
  No.102 LC CDR3
GTWDSSLSAGV

SEQ ID NO: 610 - protein, 7 aa, Artificial Sequence
  No.102 HC CDR1
TSGMGVG

SEQ ID NO: 611 - protein, 16 aa, Artificial Sequence
  No.102 HC CDR2
LIDWDDNKYYTTSLKT

SEQ ID NO: 612 - protein, 18 aa, Artificial Sequence
  No.102 HC CDR3
IPGFLRYRNRYYYYGMDV

SEQ ID NO: 613 - protein, 13 aa, Artificial Sequence
  No.103 LC CDR1
SGSSSNIGKNYVS

SEQ ID NO: 614 - protein, 7 aa, Artificial Sequence
  No.103 LC CDR2
DNNKRPS

SEQ ID NO: 615 - protein, 11 aa, Artificial Sequence
  No.103 LC CDR3
GTWDSSLSAVV

SEQ ID NO: 616 - protein, 7 aa, Artificial Sequence
  No.103 HC CDR1
TSGVGVG

SEQ ID NO: 617 - protein, 16 aa, Artificial Sequence
  No.103 HC CDR2
LIDWDDNKYYTTSLKT

SEQ ID NO: 618 - protein, 18 aa, Artificial Sequence
  No.103 HC CDR3
IPGFLRYRNRYYYYGMDV

SEQ ID NO: 619 - protein, 13 aa, Artificial Sequence
  No.104 LC CDR1
SGGSSNIGNNYVS

SEQ ID NO: 620 - protein, 7 aa, Artificial Sequence
  No.104 LC CDR2
DNNKRPS

SEQ ID NO: 621 - protein, 11 aa, Artificial Sequence
  No.104 LC CDR3
GTWDSSLSAGV

SEQ ID NO: 622 - protein, 7 aa, Artificial Sequence
  No.104 HC CDR1
TSGVGVG

SEQ ID NO: 623 - protein, 16 aa, Artificial Sequence
  No.104 HC CDR2
LIDWDDNKYYTTSLKT

SEQ ID NO: 624 - protein, 18 aa, Artificial Sequence
  No.104 HC CDR3
IPGFLRYRNRYYYYGMDV

SEQ ID NO: 625 - protein, 13 aa, Artificial Sequence
  No.105 LC CDR1
SGSSSNIGNNYVS

SEQ ID NO: 626 - protein, 7 aa, Artificial Sequence
  No.105 LC CDR2
DNNKRPS

SEQ ID NO: 627 - protein, 11 aa, Artificial Sequence
  No.105 LC CDR3
GTWDSSLSAGV

SEQ ID NO: 628 - protein, 7 aa, Artificial Sequence
  No.105 HC CDR1
TSGVGVG

SEQ ID NO: 629 - protein, 16 aa, Artificial Sequence
  No.105 HC CDR2
LIDWDDNKYYTTSLKT

SEQ ID NO: 630 - protein, 18 aa, Artificial Sequence
  No.105 HC CDR3
IPGFLRYRNRYYYYGMDV

SEQ ID NO: 631 - protein, 13 aa, Artificial Sequence
  No.106 LC CDR1
SGSSSNIGNNYVS

SEQ ID NO: 632 - protein, 7 aa, Artificial Sequence
  No.106 LC CDR2
DNNKRPS

SEQ ID NO: 633 - protein, 11 aa, Artificial Sequence
  No.106 LC CDR3
GTWDSSLSAGV

SEQ ID NO: 634 - protein, 7 aa, Artificial Sequence
  No.106 HC CDR1
TSGMGVG

SEQ ID NO: 635 - protein, 16 aa, Artificial Sequence
  No.106 HC CDR2
LIDWDDNKYYTTSLKT

SEQ ID NO: 636 - protein, 18 aa, Artificial Sequence
  No.106 HC CDR3
IPGFLRYRNRYYYYGMDV

SEQ ID NO: 637 - protein, 13 aa, Artificial Sequence
  No.107 LC CDR1
SGSSSNIGNNYVS

SEQ ID NO: 638 - protein, 7 aa, Artificial Sequence
  No.107 LC CDR2
DNNKRPS

SEQ ID NO: 639 - protein, 11 aa, Artificial Sequence
  No.107 LC CDR3
GTWDSSLSAGV

SEQ ID NO: 640 - protein, 7 aa, Artificial Sequence
  No.107 HC CDR1
TSGMGVG

SEQ ID NO: 641 - protein, 16 aa, Artificial Sequence
  No.107 HC CDR2
LIDWDDNKYYTTSLKT

SEQ ID NO: 642 - protein, 18 aa, Artificial Sequence
  No.107 HC CDR3
IPGFLRYRNRYYYYGMDV

SEQ ID NO: 643 - protein, 13 aa, Artificial Sequence
  No.108 LC CDR1
SGSSSNIGNNYVS

SEQ ID NO: 644 - protein, 7 aa, Artificial Sequence
  No.108 LC CDR2
DNNKRPS

SEQ ID NO: 645 - protein, 11 aa, Artificial Sequence
  No.108 LC CDR3
GTWDSSLSAGV

SEQ ID NO: 646 - protein, 7 aa, Artificial Sequence
  No.108 HC CDR1
TSGMGVG

SEQ ID NO: 647 - protein, 16 aa, Artificial Sequence
  No.108 HC CDR2
LIDWDDNKYYTTSLKT

SEQ ID NO: 648 - protein, 18 aa, Artificial Sequence
  No.108 HC CDR3
IPGFLRYRNRYYYYGMDV

SEQ ID NO: 649 - protein, 13 aa, Artificial Sequence
  No.109 LC CDR1
SGSSSNIGNNYVS

SEQ ID NO: 650 - protein, 7 aa, Artificial Sequence
  No.109 LC CDR2
DNNKRPS

SEQ ID NO: 651 - protein, 11 aa, Artificial Sequence
  No.109 LC CDR3
GTWDSSLSAGV

SEQ ID NO: 652 - protein, 7 aa, Artificial Sequence
  No.109 HC CDR1
TSGMGVG

SEQ ID NO: 653 - protein, 16 aa, Artificial Sequence
  No.109 HC CDR2
LIDWDDNKYYTTSLKT

SEQ ID NO: 654 - protein, 18 aa, Artificial Sequence
  No.109 HC CDR3
IPGFLRYRNRYYYYGMDV

SEQ ID NO: 655 - protein, 13 aa, Artificial Sequence
  No.110 LC CDR1
SGSSSNIGNNYVS

SEQ ID NO: 656 - protein, 7 aa, Artificial Sequence
  No.110 LC CDR2
DNNKRPS

SEQ ID NO: 657 - protein, 11 aa, Artificial Sequence
  No.110 LC CDR3
GTWDSSLSAGV

SEQ ID NO: 658 - protein, 7 aa, Artificial Sequence
  No.110 HC CDR1
TSGMGVG

SEQ ID NO: 659 - protein, 16 aa, Artificial Sequence
  No.110 HC CDR2
LIDWDDNKYYTTSLKT

SEQ ID NO: 660 - protein, 18 aa, Artificial Sequence
  No.110 HC CDR3
IPGFLRYRNRYYYYGMDV

SEQ ID NO: 661 - protein, 13 aa, Artificial Sequence
  No.111 LC CDR1
SGSSSNIGNNYVS

SEQ ID NO: 662 - protein, 7 aa, Artificial Sequence
  No.111 LC CDR2
DNNKRPS

SEQ ID NO: 663 - protein, 11 aa, Artificial Sequence
  No.111 LC CDR3
GTWDSSLSAGV

SEQ ID NO: 664 - protein, 7 aa, Artificial Sequence
  No.111 HC CDR1
TSGMGVG

SEQ ID NO: 665 - protein, 16 aa, Artificial Sequence
  No.111 HC CDR2
LIDWDDNKYYTTSLKT

SEQ ID NO: 666 - protein, 18 aa, Artificial Sequence
  No.111 HC CDR3
IPGFLRYRNRYYYYGMDV

SEQ ID NO: 667 - protein, 13 aa, Artificial Sequence
  No.112 LC CDR1
SGSSSNIGNNYVS

SEQ ID NO: 668 - protein, 7 aa, Artificial Sequence
  No.112 LC CDR2
DNNKRPS

SEQ ID NO: 669 - protein, 11 aa, Artificial Sequence
  No.112 LC CDR3
GTWDSSLSAGV

SEQ ID NO: 670 - protein, 7 aa, Artificial Sequence
  No.112 HC CDR1
TSGVGVG

SEQ ID NO: 671 - protein, 16 aa, Artificial Sequence
  No.112 HC CDR2
LIDWDDNKYYTTSLKT

SEQ ID NO: 672 - protein, 18 aa, Artificial Sequence
  No.112 HC CDR3
IPGFLRYRNRYYYYGMDV

SEQ ID NO: 673 - protein, 13 aa, Artificial Sequence
  No.113 LC CDR1
SGSNSNIGNNYIS

SEQ ID NO: 674 - protein, 7 aa, Artificial Sequence
  No.113 LC CDR2
DNNKRPS

SEQ ID NO: 675 - protein, 11 aa, Artificial Sequence
  No.113 LC CDR3
GTWDSSLSAGV

SEQ ID NO: 676 - protein, 7 aa, Artificial Sequence
  No.113 HC CDR1
TSGVGVG

SEQ ID NO: 677 - protein, 16 aa, Artificial Sequence
  No.113 HC CDR2
LIDWDDNKYYTTSLKT

SEQ ID NO: 678 - protein, 18 aa, Artificial Sequence
  No.113 HC CDR3
IPGFLRYRNRYYYYGMDV

SEQ ID NO: 679 - protein, 13 aa, Artificial Sequence
  No.114 LC CDR1
SGSSSNIGNNYVS

SEQ ID NO: 680 - protein, 7 aa, Artificial Sequence
  No.114 LC CDR2
DNNKRPS

SEQ ID NO: 681 - protein, 11 aa, Artificial Sequence
  No.114 LC CDR3
GTWDSSLSAGV

SEQ ID NO: 682 - protein, 7 aa, Artificial Sequence
  No.114 HC CDR1
TSGMGVG

SEQ ID NO: 683 - protein, 16 aa, Artificial Sequence
  No.114 HC CDR2
LIDWDDNKYYTTSLKT

SEQ ID NO: 684 - protein, 18 aa, Artificial Sequence
  No.114 HC CDR3
IPGFLRYRNRYYYYGMDV

SEQ ID NO: 685 - protein, 13 aa, Artificial Sequence
  No.115 LC CDR1
SGSSSNIGNNYVS

SEQ ID NO: 686 - protein, 7 aa, Artificial Sequence
  No.115 LC CDR2
DNNKRPS

SEQ ID NO: 687 - protein, 11 aa, Artificial Sequence
  No.115 LC CDR3
GTWDSSLSAGV

SEQ ID NO: 688 - protein, 7 aa, Artificial Sequence
  No.115 HC CDR1
TSGMGVG

SEQ ID NO: 689 - protein, 16 aa, Artificial Sequence
  No.115 HC CDR2
LIDWDDNKYYTTSLKT

SEQ ID NO: 690 - protein, 18 aa, Artificial Sequence
  No.115 HC CDR3
IPGFLRYRNRYYYYGMDV

SEQ ID NO: 691 - protein, 13 aa, Artificial Sequence
  No.116 LC CDR1
SGSSSNIGNNYVS

SEQ ID NO: 692 - protein, 7 aa, Artificial Sequence
  No.116 LC CDR2
DNNKRPS

SEQ ID NO: 693 - protein, 11 aa, Artificial Sequence
  No.116 LC CDR3
GTWDSSLSAGV

SEQ ID NO: 694 - protein, 7 aa, Artificial Sequence
  No.116 HC CDR1
TSGMGVG

SEQ ID NO: 695 - protein, 16 aa, Artificial Sequence
  No.116 HC CDR2
LIDWDDNKYYTTSLKT

SEQ ID NO: 696 - protein, 18 aa, Artificial Sequence
  No.116 HC CDR3
IPGFLRYRNRYYYYGMDV

SEQ ID NO: 697 - protein, 13 aa, Artificial Sequence
  No.117 LC CDR1
SGSSSNIGNNYVS

SEQ ID NO: 698 - protein, 7 aa, Artificial Sequence
  No.117 LC CDR2
DNNKRPS

SEQ ID NO: 699 - protein, 11 aa, Artificial Sequence
  No.117 LC CDR3
GTWDSSLSAGV

SEQ ID NO: 700 - protein, 7 aa, Artificial Sequence
  No.117 HC CDR1
TSGMGVG

SEQ ID NO: 701 - protein, 16 aa, Artificial Sequence
  No.117 HC CDR2
LIDWDDNKYYTTSLKT

SEQ ID NO: 702 - protein, 18 aa, Artificial Sequence
  No.117 HC CDR3
IPGFLRYRNRYYYYGMDV

SEQ ID NO: 703 - protein, 13 aa, Artificial Sequence
  No.118 LC CDR1
SGSNSNIGNNYVS

SEQ ID NO: 704 - protein, 7 aa, Artificial Sequence
  No.118 LC CDR2
DNNKRPS

SEQ ID NO: 705 - protein, 11 aa, Artificial Sequence
  No.118 LC CDR3
GTWDNSLSAGV

SEQ ID NO: 706 - protein, 7 aa, Artificial Sequence
  No.118 HC CDR1
TSGMGVG

SEQ ID NO: 707 - protein, 16 aa, Artificial Sequence
  No.118 HC CDR2
LIDWDDNKYYTTSLKT

SEQ ID NO: 708 - protein, 18 aa, Artificial Sequence
  No.118 HC CDR3
IPGFLRYRNRYYYYGMDV

SEQ ID NO: 709 - protein, 13 aa, Artificial Sequence
  No.119 LC CDR1
SGSSSNIGNNYVS

SEQ ID NO: 710 - protein, 7 aa, Artificial Sequence
  No.119 LC CDR2
DNNKRPS

SEQ ID NO: 711 - protein, 11 aa, Artificial Sequence
  No.119 LC CDR3
GTWDSSLSAGV

SEQ ID NO: 712 - protein, 7 aa, Artificial Sequence
  No.119 HC CDR1
TSGMGVG

SEQ ID NO: 713 - protein, 16 aa, Artificial Sequence
  No.119 HC CDR2
LIDWDDNKYYTTSLKT

SEQ ID NO: 714 - protein, 18 aa, Artificial Sequence
  No.119 HC CDR3
IPGFLRYRNRYYYYGMDV

SEQ ID NO: 715 - protein, 13 aa, Artificial Sequence
  No.120 LC CDR1
SGSSSNIGNNYVS

SEQ ID NO: 716 - protein, 7 aa, Artificial Sequence
  No.120 LC CDR2
DNNKRPS

SEQ ID NO: 717 - protein, 11 aa, Artificial Sequence
  No.120 LC CDR3
GTWDSSLSAVV

SEQ ID NO: 718 - protein, 7 aa, Artificial Sequence
  No.120 HC CDR1
TSGVGVG

SEQ ID NO: 719 - protein, 16 aa, Artificial Sequence
  No.120 HC CDR2
LIDWDDNKYYTTSLKT

SEQ ID NO: 720 - protein, 18 aa, Artificial Sequence
  No.120 HC CDR3
IPGFLRYRNRYYYYGMDV

SEQ ID NO: 721 - protein, 13 aa, Artificial Sequence
  No.121 LC CDR1
SGSSSNIGNNYVS

SEQ ID NO: 722 - protein, 7 aa, Artificial Sequence
  No.121 LC CDR2
DNNKRPS

SEQ ID NO: 723 - protein, 11 aa, Artificial Sequence
  No.121 LC CDR3
GTWDSSLSAGV

SEQ ID NO: 724 - protein, 7 aa, Artificial Sequence
  No.121 HC CDR1
TSGMGVG

SEQ ID NO: 725 - protein, 16 aa, Artificial Sequence
  No.121 HC CDR2
LIDWDDNKYYTTSLKT

SEQ ID NO: 726 - protein, 18 aa, Artificial Sequence
  No.121 HC CDR3
IPGFLRYRNRYYYYGMDV

SEQ ID NO: 727 - protein, 13 aa, Artificial Sequence
  No.122 LC CDR1
SGSSSNIGNNYVS

SEQ ID NO: 728 - protein, 7 aa, Artificial Sequence
  No.122 LC CDR2
DNNKRPS

SEQ ID NO: 729 - protein, 11 aa, Artificial Sequence
  No.122 LC CDR3
GTWDSSLSAGV

SEQ ID NO: 730 - protein, 7 aa, Artificial Sequence
  No.122 HC CDR1
TSGMGVG

SEQ ID NO: 731 - protein, 16 aa, Artificial Sequence
  No.122 HC CDR2
LIDWDDNKYYTTSLKT

SEQ ID NO: 732 - protein, 18 aa, Artificial Sequence
  No.122 HC CDR3
IPGFLRYRNRYYYYGMDV

SEQ ID NO: 733 - protein, 13 aa, Artificial Sequence
  No.123 LC CDR1
SGSSSNIGNNYVS

SEQ ID NO: 734 - protein, 7 aa, Artificial Sequence
  No.123 LC CDR2
DNNKRPS

SEQ ID NO: 735 - protein, 11 aa, Artificial Sequence
  No.123 LC CDR3
GTWDSSLSAGV

SEQ ID NO: 736 - protein, 7 aa, Artificial Sequence
  No.123 HC CDR1
TSGMGVG

SEQ ID NO: 737 - protein, 16 aa, Artificial Sequence
  No.123 HC CDR2
LIDWDDNKYYTTSLKT

SEQ ID NO: 738 - protein, 18 aa, Artificial Sequence
  No.123 HC CDR3
IPGFLRYRNRYYYYGMDV

SEQ ID NO: 739 - protein, 13 aa, Artificial Sequence
  No.124 LC CDR1
SGSSSNIGNNYVS

SEQ ID NO: 740 - protein, 7 aa, Artificial Sequence
  No.124 LC CDR2
DNNKRPS

SEQ ID NO: 741 - protein, 11 aa, Artificial Sequence
  No.124 LC CDR3
GTWDNSLSAGV

SEQ ID NO: 742 - protein, 7 aa, Artificial Sequence
  No.124 HC CDR1
TSGVGVG

SEQ ID NO: 743 - protein, 16 aa, Artificial Sequence
  No.124 HC CDR2
LIDWDDNKYYTTSLKT

SEQ ID NO: 744 - protein, 18 aa, Artificial Sequence
  No.124 HC CDR3
IPGFLRYRNRYYYYGMDV

SEQ ID NO: 745 - protein, 13 aa, Artificial Sequence
  No.125 LC CDR1
SGSSSNIGNNYVS

SEQ ID NO: 746 - protein, 7 aa, Artificial Sequence
  No.125 LC CDR2
DNNKRPS

SEQ ID NO: 747 - protein, 11 aa, Artificial Sequence
  No.125 LC CDR3
GTWDSSLSAGV

SEQ ID NO: 748 - protein, 7 aa, Artificial Sequence
  No.125 HC CDR1
TSGMGVG

SEQ ID NO: 749 - protein, 16 aa, Artificial Sequence
  No.125 HC CDR2
LIDWDDNKYYTTSLKT

SEQ ID NO: 750 - protein, 18 aa, Artificial Sequence
  No.125 HC CDR3
IPGFLRYRNRYYYYGMDV

SEQ ID NO: 751 - protein, 13 aa, Artificial Sequence
  No.126 LC CDR1
SGSSSNIGNNYVS

SEQ ID NO: 752 - protein, 7 aa, Artificial Sequence
  No.126 LC CDR2
DNNKRPS

SEQ ID NO: 753 - protein, 11 aa, Artificial Sequence
  No.126 LC CDR3
GTWDSSLSAGV

SEQ ID NO: 754 - protein, 7 aa, Artificial Sequence
  No.126 HC CDR1
TSGMGVG

SEQ ID NO: 755 - protein, 16 aa, Artificial Sequence
  No.126 HC CDR2
LIDWDDNKYYTTSLKT

SEQ ID NO: 756 - protein, 18 aa, Artificial Sequence
  No.126 HC CDR3
IPGFLRYRNRYYYYGMDV

SEQ ID NO: 757 - protein, 13 aa, Artificial Sequence
  No.127 LC CDR1
SGSSSNIGNNYVS

SEQ ID NO: 758 - protein, 7 aa, Artificial Sequence
  No.127 LC CDR2
DNNKRPS

SEQ ID NO: 759 - protein, 11 aa, Artificial Sequence
  No.127 LC CDR3
GTWDNSLSAGV

SEQ ID NO: 760 - protein, 7 aa, Artificial Sequence
  No.127 HC CDR1
TSGVGVG

SEQ ID NO: 761 - protein, 16 aa, Artificial Sequence
  No.127 HC CDR2
LIDWDDNKYYTTSLKT

SEQ ID NO: 762 - protein, 18 aa, Artificial Sequence
  No.127 HC CDR3
IPGFLRYRNRYYYYGMDV

SEQ ID NO: 763 - protein, 13 aa, Artificial Sequence
  No.128 LC CDR1
SGSTSNIGNNFVS

SEQ ID NO: 764 - protein, 7 aa, Artificial Sequence
  No.128 LC CDR2
DNDKRPS

SEQ ID NO: 765 - protein, 11 aa, Artificial Sequence
  No.128 LC CDR3
GTWDSSLSAGV

SEQ ID NO: 766 - protein, 7 aa, Artificial Sequence
  No.128 HC CDR1
TSGVGVG

SEQ ID NO: 767 - protein, 16 aa, Artificial Sequence
  No.128 HC CDR2
LIDWDDNKYYTTSLKT

SEQ ID NO: 768 - protein, 18 aa, Artificial Sequence
  No.128 HC CDR3
IPGFLRYRNRYYYYGMDV

SEQ ID NO: 769 - protein, 13 aa, Artificial Sequence
  No.129 LC CDR1
SGSNSNIGNNYVS

SEQ ID NO: 770 - protein, 7 aa, Artificial Sequence
  No.129 LC CDR2
DNNKRPS

SEQ ID NO: 771 - protein, 11 aa, Artificial Sequence
  No.129 LC CDR3
GTWDNNLSAGV

SEQ ID NO: 772 - protein, 7 aa, Artificial Sequence
  No.129 HC CDR1
TSGVGVG

SEQ ID NO: 773 - protein, 16 aa, Artificial Sequence
  No.129 HC CDR2
LIDWDDNKYYTTSLKT

SEQ ID NO: 774 - protein, 18 aa, Artificial Sequence
  No.129 HC CDR3
IPGFLRYRNRYYYYGMDV

SEQ ID NO: 775 - protein, 13 aa, Artificial Sequence
  No.130 LC CDR1
SGSSSNIGNNYVS

SEQ ID NO: 776 - protein, 7 aa, Artificial Sequence
  No.130 LC CDR2
DNNKRPS

SEQ ID NO: 777 - protein, 11 aa, Artificial Sequence
  No.130 LC CDR3
GTWDSSLSAGV

SEQ ID NO: 778 - protein, 7 aa, Artificial Sequence
  No.130 HC CDR1
TSGMGVG

SEQ ID NO: 779 - protein, 16 aa, Artificial Sequence
  No.130 HC CDR2
LIDWDDNKYYTTSLKT

SEQ ID NO: 780 - protein, 18 aa, Artificial Sequence
  No.130 HC CDR3
IPGFLRYRNRYYYYGMDV

SEQ ID NO: 781 - protein, 13 aa, Artificial Sequence
  No.131 LC CDR1
SGSSSNIGNNYVS

SEQ ID NO: 782 - protein, 7 aa, Artificial Sequence
  No.131 LC CDR2
DNNKRPS

SEQ ID NO: 783 - protein, 11 aa, Artificial Sequence
  No.131 LC CDR3
GTWDSSLSAGV

SEQ ID NO: 784 - protein, 7 aa, Artificial Sequence
  No.131 HC CDR1
TSGVGVG

SEQ ID NO: 785 - protein, 16 aa, Artificial Sequence
  No.131 HC CDR2
LIDWDDNKYYTTSLKT

SEQ ID NO: 786 - protein, 18 aa, Artificial Sequence
  No.131 HC CDR3
IPGFLRYRNRYYYYGMDV

SEQ ID NO: 787 - protein, 13 aa, Artificial Sequence
  No.132 LC CDR1
SGSSSNIGNNYVS

SEQ ID NO: 788 - protein, 7 aa, Artificial Sequence
  No.132 LC CDR2
DNNKRPS

SEQ ID NO: 789 - protein, 11 aa, Artificial Sequence
  No.132 LC CDR3
GTWDSSLSAGV

SEQ ID NO: 790 - protein, 7 aa, Artificial Sequence
  No.132 HC CDR1
TSGMGVG

SEQ ID NO: 791 - protein, 16 aa, Artificial Sequence
  No.132 HC CDR2
LIDWDDNKYYTTSLKT

SEQ ID NO: 792 - protein, 18 aa, Artificial Sequence
  No.132 HC CDR3
IPGFLRYRNRYYYYGMDV

SEQ ID NO: 793 - protein, 13 aa, Artificial Sequence
  No.133 LC CDR1
SGSSSNIGNNYVS

SEQ ID NO: 794 - protein, 7 aa, Artificial Sequence
  No.133 LC CDR2
DNNKRPS

SEQ ID NO: 795 - protein, 11 aa, Artificial Sequence
  No.133 LC CDR3
GTWDSSLSAGV

SEQ ID NO: 796 - protein, 7 aa, Artificial Sequence
  No.133 HC CDR1
TSGMGVG

SEQ ID NO: 797 - protein, 16 aa, Artificial Sequence
  No.133 HC CDR2
LIDWDDNKYYTTSLKT

SEQ ID NO: 798 - protein, 18 aa, Artificial Sequence
  No.133 HC CDR3
IPGFLRYRNRYYYYGMDV

SEQ ID NO: 799 - protein, 13 aa, Artificial Sequence
  No.134 LC CDR1
SGSSSNIGNNYVS

SEQ ID NO: 800 - protein, 7 aa, Artificial Sequence
  No.134 LC CDR2
DNNKRPS

SEQ ID NO: 801 - protein, 11 aa, Artificial Sequence
  No.134 LC CDR3
GTWDSSLSAGV

SEQ ID NO: 802 - protein, 7 aa, Artificial Sequence
  No.134 HC CDR1
TSGMGVG

SEQ ID NO: 803 - protein, 16 aa, Artificial Sequence
  No.134 HC CDR2
LIDWDDNKYYTTSLKT

SEQ ID NO: 804 - protein, 18 aa, Artificial Sequence
  No.134 HC CDR3
IPGFLRYRNRYYYYGMDV

SEQ ID NO: 805 - protein, 13 aa, Artificial Sequence
  No.135 LC CDR1
SGSSSNIGNNYVS

SEQ ID NO: 806 - protein, 7 aa, Artificial Sequence
  No.135 LC CDR2
DNNKRPS

SEQ ID NO: 807 - protein, 11 aa, Artificial Sequence
  No.135 LC CDR3
GTWDSSLSAGV

SEQ ID NO: 808 - protein, 7 aa, Artificial Sequence
  No.135 HC CDR1
TSGMGVG

SEQ ID NO: 809 - protein, 16 aa, Artificial Sequence
  No.135 HC CDR2
LIDWDDNKYYTTSLKT

SEQ ID NO: 810 - protein, 18 aa, Artificial Sequence
  No.135 HC CDR3
IPGFLRYRNRYYYYGMDV

SEQ ID NO: 811 - protein, 13 aa, Artificial Sequence
  No.136 LC CDR1
SGSSSNIGNNYVS

SEQ ID NO: 812 - protein, 7 aa, Artificial Sequence
  No.136 LC CDR2
DNNKRPS

SEQ ID NO: 813 - protein, 11 aa, Artificial Sequence
  No.136 LC CDR3
GTWDSSLSAGV

SEQ ID NO: 814 - protein, 7 aa, Artificial Sequence
  No.136 HC CDR1
TSGMGVG

SEQ ID NO: 815 - protein, 16 aa, Artificial Sequence
  No.136 HC CDR2
LIDWDDNKYYTTSLKT

SEQ ID NO: 816 - protein, 18 aa, Artificial Sequence
  No.136 HC CDR3
IPGFLRYRNRYYYYGMDV

SEQ ID NO: 817 - protein, 13 aa, Artificial Sequence
  No.137 LC CDR1
SGSSSNIGNNYVS

SEQ ID NO: 818 - protein, 7 aa, Artificial Sequence
  No.137 LC CDR2
DNNKRPS

SEQ ID NO: 819 - protein, 11 aa, Artificial Sequence
  No.137 LC CDR3
GTWDSSLSAGV

SEQ ID NO: 820 - protein, 7 aa, Artificial Sequence
  No.137 HC CDR1
TSGVGVG

SEQ ID NO: 821 - protein, 16 aa, Artificial Sequence
  No.137 HC CDR2
LIDWDDNKYYTTSLKT

SEQ ID NO: 822 - protein, 18 aa, Artificial Sequence
  No.137 HC CDR3
IPGFLRYRNRYYYYGMDV

SEQ ID NO: 823 - protein, 13 aa, Artificial Sequence
  No.138 LC CDR1
SGSSSNIGNNYVS

SEQ ID NO: 824 - protein, 7 aa, Artificial Sequence
  No.138 LC CDR2
DNNKRPS

SEQ ID NO: 825 - protein, 11 aa, Artificial Sequence
  No.138 LC CDR3
GTWDSSLSAGV

SEQ ID NO: 826 - protein, 7 aa, Artificial Sequence
  No.138 HC CDR1
TSGVGVG

SEQ ID NO: 827 - protein, 16 aa, Artificial Sequence
  No.138 HC CDR2
LIDWDDNKYYTTSLKT

SEQ ID NO: 828 - protein, 18 aa, Artificial Sequence
  No.138 HC CDR3
IPGFLRYRNRYYYYGMDV

SEQ ID NO: 829 - protein, 13 aa, Artificial Sequence
  No.139 LC CDR1
SGSSSNIGNNYVS

SEQ ID NO: 830 - protein, 7 aa, Artificial Sequence
  No.139 LC CDR2
DNNKRPS

SEQ ID NO: 831 - protein, 11 aa, Artificial Sequence
  No.139 LC CDR3
GTWDSSLSAGV

SEQ ID NO: 832 - protein, 7 aa, Artificial Sequence
  No.139 HC CDR1
TSGVGVG

SEQ ID NO: 833 - protein, 16 aa, Artificial Sequence
  No.139 HC CDR2
LIDWDDNKYHTTSLKT

SEQ ID NO: 834 - protein, 18 aa, Artificial Sequence
  No.139 HC CDR3
IPGFLRYRNRYYYYGMDV

SEQ ID NO: 835 - protein, 13 aa, Artificial Sequence
  No.140 LC CDR1
SGSSSNIGNNYVS

SEQ ID NO: 836 - protein, 7 aa, Artificial Sequence
  No.140 LC CDR2
DNNKRPS

SEQ ID NO: 837 - protein, 11 aa, Artificial Sequence
  No.140 LC CDR3
GTWDSSLSAGV

SEQ ID NO: 838 - protein, 7 aa, Artificial Sequence
  No.140 HC CDR1
TSGMGVS

SEQ ID NO: 839 - protein, 16 aa, Artificial Sequence
  No.140 HC CDR2
LIDWDDNKYYTTSLKT

SEQ ID NO: 840 - protein, 18 aa, Artificial Sequence
  No.140 HC CDR3
IPGFLRYRNRYYYYGMDV

SEQ ID NO: 841 - protein, 13 aa, Artificial Sequence
  No.141 LC CDR1
SGSSSNIGNNYVS

SEQ ID NO: 842 - protein, 7 aa, Artificial Sequence
  No.141 LC CDR2
DNNKRPS

SEQ ID NO: 843 - protein, 11 aa, Artificial Sequence
  No.141 LC CDR3
GTWDSSLSAGV

SEQ ID NO: 844 - protein, 7 aa, Artificial Sequence
  No.141 HC CDR1
TSGMGVG

SEQ ID NO: 845 - protein, 16 aa, Artificial Sequence
  No.141 HC CDR2
LIDWDDNKYYTTSLKT

SEQ ID NO: 846 - protein, 18 aa, Artificial Sequence
  No.141 HC CDR3
IPGFLRYRNRYYYYGMDV

SEQ ID NO: 847 - protein, 13 aa, Artificial Sequence
  No.142 LC CDR1
SGSSSNIGNNYVS

SEQ ID NO: 848 - protein, 7 aa, Artificial Sequence
  No.142 LC CDR2
DNNKRPS

SEQ ID NO: 849 - protein, 11 aa, Artificial Sequence
  No.142 LC CDR3
GTWDSSLSAGV

SEQ ID NO: 850 - protein, 7 aa, Artificial Sequence
  No.142 HC CDR1
TSGMGVG

SEQ ID NO: 851 - protein, 16 aa, Artificial Sequence
  No.142 HC CDR2
LIDWDDNKYYTTSLKT

SEQ ID NO: 852 - protein, 18 aa, Artificial Sequence
  No.142 HC CDR3
IPGFLRYRNRYYYYGMDV

SEQ ID NO: 853 - protein, 13 aa, Artificial Sequence
  No.143 LC CDR1
SGSSSNIGNNYVS

SEQ ID NO: 854 - protein, 7 aa, Artificial Sequence
  No.143 LC CDR2
DNNKRPS

SEQ ID NO: 855 - protein, 11 aa, Artificial Sequence
  No.143 LC CDR3
GTWDSSLSAGV

SEQ ID NO: 856 - protein, 7 aa, Artificial Sequence
  No.143 HC CDR1
TSGVGVG

SEQ ID NO: 857 - protein, 16 aa, Artificial Sequence
  No.143 HC CDR2
LIDWDDNKYYTTSLKT

SEQ ID NO: 858 - protein, 18 aa, Artificial Sequence
  No.143 HC CDR3
IPGFLRYRNRYYYYGMDV

SEQ ID NO: 859 - protein, 13 aa, Artificial Sequence
  No.144 LC CDR1
SGSSSNIGNNYVS

SEQ ID NO: 860 - protein, 7 aa, Artificial Sequence
  No.144 LC CDR2
DNNKRPS

SEQ ID NO: 861 - protein, 11 aa, Artificial Sequence
  No.144 LC CDR3
GTWDSSLSAGV

SEQ ID NO: 862 - protein, 7 aa, Artificial Sequence
  No.144 HC CDR1
TSGMGVG

SEQ ID NO: 863 - protein, 16 aa, Artificial Sequence
  No.144 HC CDR2
LIDWDDNKYYTTSLKT

SEQ ID NO: 864 - protein, 18 aa, Artificial Sequence
  No.144 HC CDR3
IPGFLRYRNRYYYYGMDV

SEQ ID NO: 865 - protein, 13 aa, Artificial Sequence
  No.145 LC CDR1
SGSSSNIGKNYVS

SEQ ID NO: 866 - protein, 7 aa, Artificial Sequence
  No.145 LC CDR2
DNNKRPS

SEQ ID NO: 867 - protein, 11 aa, Artificial Sequence
  No.145 LC CDR3
GTWDSSLSAVV

SEQ ID NO: 868 - protein, 7 aa, Artificial Sequence
  No.145 HC CDR1
TSGVGVG

SEQ ID NO: 869 - protein, 16 aa, Artificial Sequence
  No.145 HC CDR2
LIDWDDNKYYTTSLKT

SEQ ID NO: 870 - protein, 18 aa, Artificial Sequence
  No.145 HC CDR3
IPGFLRYRNRYYYYGMDV

SEQ ID NO: 871 - protein, 13 aa, Artificial Sequence
  No.146 LC CDR1
SGSSSNIGNNYVS

SEQ ID NO: 872 - protein, 7 aa, Artificial Sequence
  No.146 LC CDR2
DNNKRPS

SEQ ID NO: 873 - protein, 11 aa, Artificial Sequence
  No.146 LC CDR3
GTWDSSLSAGV

SEQ ID NO: 874 - protein, 7 aa, Artificial Sequence
  No.146 HC CDR1
TSGMGVG

SEQ ID NO: 875 - protein, 16 aa, Artificial Sequence
  No.146 HC CDR2
LIDWDDNKYYTTSLKT

SEQ ID NO: 876 - protein, 18 aa, Artificial Sequence
  No.146 HC CDR3
IPGFLRYRNRYYYYGMDV

SEQ ID NO: 877 - protein, 13 aa, Artificial Sequence
  No.147 LC CDR1
SGSSSNIGNNYVS

SEQ ID NO: 878 - protein, 7 aa, Artificial Sequence
  No.147 LC CDR2
DNNKRPS

SEQ ID NO: 879 - protein, 11 aa, Artificial Sequence
  No.147 LC CDR3
GTWDSSLSGGV

SEQ ID NO: 880 - protein, 7 aa, Artificial Sequence
  No.147 HC CDR1
TSGMGVG

SEQ ID NO: 881 - protein, 16 aa, Artificial Sequence
  No.147 HC CDR2
LIDWDDNKYYTTSLKT

SEQ ID NO: 882 - protein, 18 aa, Artificial Sequence
  No.147 HC CDR3
IPGFLRYRNRYYYYGMDV

SEQ ID NO: 883 - protein, 13 aa, Artificial Sequence
  No.148 LC CDR1
SGSSSNIGNNYVS

SEQ ID NO: 884 - protein, 7 aa, Artificial Sequence
  No.148 LC CDR2
DNNKRPS

SEQ ID NO: 885 - protein, 11 aa, Artificial Sequence
  No.148 LC CDR3
GTWDSSLSAGV

SEQ ID NO: 886 - protein, 7 aa, Artificial Sequence
  No.148 HC CDR1
TSGMGVG

SEQ ID NO: 887 - protein, 16 aa, Artificial Sequence
  No.148 HC CDR2
LIDWDDNKYYTTSLKT

SEQ ID NO: 888 - protein, 18 aa, Artificial Sequence
  No.148 HC CDR3
IPGFLRYRNRYYYYGMDV

SEQ ID NO: 889 - protein, 13 aa, Artificial Sequence
  No.149 LC CDR1
SGSSSNIGNNYVS

SEQ ID NO: 890 - protein, 7 aa, Artificial Sequence
  No.149 LC CDR2
DNNKRPS

SEQ ID NO: 891 - protein, 11 aa, Artificial Sequence
  No.149 LC CDR3
GTWDSSLSAGV

SEQ ID NO: 892 - protein, 7 aa, Artificial Sequence
  No.149 HC CDR1
TSGMGVG

SEQ ID NO: 893 - protein, 16 aa, Artificial Sequence
  No.149 HC CDR2
LIDWDDNKYYTTSLKT

SEQ ID NO: 894 - protein, 18 aa, Artificial Sequence
  No.149 HC CDR3
IPGFLRYRNRYYYYGMDV

SEQ ID NO: 895 - protein, 13 aa, Artificial Sequence
  No.150 LC CDR1
SGSSSNIGNNYVS

SEQ ID NO: 896 - protein, 7 aa, Artificial Sequence
  No.150 LC CDR2
DNNKRPS

SEQ ID NO: 897 - protein, 11 aa, Artificial Sequence
  No.150 LC CDR3
GTWDSSLSAGV

SEQ ID NO: 898 - protein, 7 aa, Artificial Sequence
  No.150 HC CDR1
TSGMGVG

SEQ ID NO: 899 - protein, 16 aa, Artificial Sequence
  No.150 HC CDR2
LIDWDDNKYYTTSLKT

SEQ ID NO: 900 - protein, 18 aa, Artificial Sequence
  No.150 HC CDR3
IPGFLRYRNRYYYYGMDV

SEQ ID NO: 901 - protein, 13 aa, Artificial Sequence
  No.151 LC CDR1
SGSSSNIGNNYVS

SEQ ID NO: 902 - protein, 7 aa, Artificial Sequence
  No.151 LC CDR2
DNNKRPS

SEQ ID NO: 903 - protein, 11 aa, Artificial Sequence
  No.151 LC CDR3
GTWDSSLSAGV

SEQ ID NO: 904 - protein, 7 aa, Artificial Sequence
  No.151 HC CDR1
TSGVGVG

SEQ ID NO: 905 - protein, 16 aa, Artificial Sequence
  No.151 HC CDR2
LIDWDDNKYYTTSLKT

SEQ ID NO: 906 - protein, 18 aa, Artificial Sequence
  No.151 HC CDR3
IPGFLRYRNRYYYYGMDV

SEQ ID NO: 907 - protein, 13 aa, Artificial Sequence
  No.152 LC CDR1
SGRSSNIGNNYVS

SEQ ID NO: 908 - protein, 7 aa, Artificial Sequence
  No.152 LC CDR2
DNNKRPS

SEQ ID NO: 909 - protein, 11 aa, Artificial Sequence
  No.152 LC CDR3
GTWDSSLSAGV

SEQ ID NO: 910 - protein, 7 aa, Artificial Sequence
  No.152 HC CDR1
TSGMGVG

SEQ ID NO: 911 - protein, 16 aa, Artificial Sequence
  No.152 HC CDR2
LIDWDDNKYYTTSLKT

SEQ ID NO: 912 - protein, 18 aa, Artificial Sequence
  No.152 HC CDR3
IPGFLRYRNRYYYYGMDV

SEQ ID NO: 913 - protein, 13 aa, Artificial Sequence
  No.153 LC CDR1
SGSSSNIGNNYVS

SEQ ID NO: 914 - protein, 7 aa, Artificial Sequence
  No.153 LC CDR2
DNNKRPS

SEQ ID NO: 915 - protein, 11 aa, Artificial Sequence
  No.153 LC CDR3
GTWDSSLSAGV

SEQ ID NO: 916 - protein, 7 aa, Artificial Sequence
  No.153 HC CDR1
TSGVGVG

SEQ ID NO: 917 - protein, 16 aa, Artificial Sequence
  No.153 HC CDR2
LIDWDDNKYYTTSLKT

SEQ ID NO: 918 - protein, 18 aa, Artificial Sequence
  No.153 HC CDR3
IPGFLRYRNRYYYYGMDV

SEQ ID NO: 919 - protein, 13 aa, Artificial Sequence
  No.154 LC CDR1
SGSSSNIGKNYVS

SEQ ID NO: 920 - protein, 7 aa, Artificial Sequence
  No.154 LC CDR2
DNNKRPS

SEQ ID NO: 921 - protein, 11 aa, Artificial Sequence
  No.154 LC CDR3
GTWDSSLSAVV

SEQ ID NO: 922 - protein, 7 aa, Artificial Sequence
  No.154 HC CDR1
TSGVGVG

SEQ ID NO: 923 - protein, 16 aa, Artificial Sequence
  No.154 HC CDR2
LIDWDDNKYYTTSLKT

SEQ ID NO: 924 - protein, 18 aa, Artificial Sequence
  No.154 HC CDR3
IPGFLRYRNRYYYYGMDV

SEQ ID NO: 925 - protein, 13 aa, Artificial Sequence
  No.155 LC CDR1
SGSSSNIGNNYVS

SEQ ID NO: 926 - protein, 7 aa, Artificial Sequence
  No.155 LC CDR2
DNNKRPS

SEQ ID NO: 927 - protein, 11 aa, Artificial Sequence
  No.155 LC CDR3
GTWDSSLSAGV

SEQ ID NO: 928 - protein, 7 aa, Artificial Sequence
  No.155 HC CDR1
TSGMGVG

SEQ ID NO: 929 - protein, 16 aa, Artificial Sequence
  No.155 HC CDR2
LIDWDDNKYYTTSLKT

SEQ ID NO: 930 - protein, 18 aa, Artificial Sequence
  No.155 HC CDR3
IPGFLRYRNRYYYYGMDV

SEQ ID NO: 931 - protein, 13 aa, Artificial Sequence
  No.156 LC CDR1
SGSSSNIGNNYVS

SEQ ID NO: 932 - protein, 7 aa, Artificial Sequence
  No.156 LC CDR2
DNNKRPS

SEQ ID NO: 933 - protein, 11 aa, Artificial Sequence
  No.156 LC CDR3
GTWDSSLSAGV

SEQ ID NO: 934 - protein, 7 aa, Artificial Sequence
  No.156 HC CDR1
TSGMGVG

SEQ ID NO: 935 - protein, 16 aa, Artificial Sequence
  No.156 HC CDR2
LIDWDDNKYYTTSLKT

SEQ ID NO: 936 - protein, 18 aa, Artificial Sequence
  No.156 HC CDR3
IPGFLRYRNRYYYYGMDV

SEQ ID NO: 937 - protein, 13 aa, Artificial Sequence
  No.157 LC CDR1
SGSSSNIGNNYVS

SEQ ID NO: 938 - protein, 7 aa, Artificial Sequence
  No.157 LC CDR2
DNNKRPS

SEQ ID NO: 939 - protein, 11 aa, Artificial Sequence
  No.157 LC CDR3
GTWDSSLSAVV

SEQ ID NO: 940 - protein, 7 aa, Artificial Sequence
  No.157 HC CDR1
TSGVGVG

SEQ ID NO: 941 - protein, 16 aa, Artificial Sequence
  No.157 HC CDR2
LIDWDDNKYYTTSLKT

SEQ ID NO: 942 - protein, 18 aa, Artificial Sequence
  No.157 HC CDR3
IPGFLRYRNRYYYYGMDV

SEQ ID NO: 943 - protein, 13 aa, Artificial Sequence
  No.158 LC CDR1
SGSSSNIGNNYVS

SEQ ID NO: 944 - protein, 7 aa, Artificial Sequence
  No.158 LC CDR2
DNNKRPS

SEQ ID NO: 945 - protein, 11 aa, Artificial Sequence
  No.158 LC CDR3
GTWDSSLSAVV

SEQ ID NO: 946 - protein, 7 aa, Artificial Sequence
  No.158 HC CDR1
TSGVGVG

SEQ ID NO: 947 - protein, 16 aa, Artificial Sequence
  No.158 HC CDR2
LIDWDDNKYYTTSLKT

SEQ ID NO: 948 - protein, 18 aa, Artificial Sequence
  No.158 HC CDR3
IPGFLRYRNRYYYYGMDV

SEQ ID NO: 949 - protein, 13 aa, Artificial Sequence
  No.159 LC CDR1
SGSSSNIGNNYVS

SEQ ID NO: 950 - protein, 7 aa, Artificial Sequence
  No.159 LC CDR2
DNNKRPS

SEQ ID NO: 951 - protein, 11 aa, Artificial Sequence
  No.159 LC CDR3
GTWDSSLSAGV

SEQ ID NO: 952 - protein, 7 aa, Artificial Sequence
  No.159 HC CDR1
TSGVGVG

SEQ ID NO: 953 - protein, 16 aa, Artificial Sequence
  No.159 HC CDR2
LIDWDDNKYYTTSLKT

SEQ ID NO: 954 - protein, 18 aa, Artificial Sequence
  No.159 HC CDR3
IPGFLRYRNRYYYYGMDV

SEQ ID NO: 955 - protein, 13 aa, Artificial Sequence
  No.160 LC CDR1
SGSSSNIGNNYVS

SEQ ID NO: 956 - protein, 7 aa, Artificial Sequence
  No.160 LC CDR2
DNNKRPS

SEQ ID NO: 957 - protein, 11 aa, Artificial Sequence
  No.160 LC CDR3
GTWDSSLSAGV

SEQ ID NO: 958 - protein, 7 aa, Artificial Sequence
  No.160 HC CDR1
TSGVGVG

SEQ ID NO: 959 - protein, 16 aa, Artificial Sequence
  No.160 HC CDR2
LIDWDDNKYYTTSLKT

SEQ ID NO: 960 - protein, 18 aa, Artificial Sequence
  No.160 HC CDR3
IPGFLRYRNRYYYYGMDV

SEQ ID NO: 961 - protein, 13 aa, Artificial Sequence
  No.161 LC CDR1
SGSSSNIGNNYVS

SEQ ID NO: 962 - protein, 7 aa, Artificial Sequence
  No.161 LC CDR2
DNNKRPS

SEQ ID NO: 963 - protein, 11 aa, Artificial Sequence
  No.161 LC CDR3
GTWDSSLSAGV

SEQ ID NO: 964 - protein, 7 aa, Artificial Sequence
  No.161 HC CDR1
TSGMGVG

SEQ ID NO: 965 - protein, 16 aa, Artificial Sequence
  No.161 HC CDR2
LIDWDDNKYYTTSLKT

SEQ ID NO: 966 - protein, 18 aa, Artificial Sequence
  No.161 HC CDR3
IPGFLRYRNRYYYYGMDV

SEQ ID NO: 967 - protein, 13 aa, Artificial Sequence
  No.162 LC CDR1
SGSSSNIGKNYVS

SEQ ID NO: 968 - protein, 7 aa, Artificial Sequence
  No.162 LC CDR2
DNNKRPS

SEQ ID NO: 969 - protein, 11 aa, Artificial Sequence
  No.162 LC CDR3
GTWDSSLSAVV

SEQ ID NO: 970 - protein, 7 aa, Artificial Sequence
  No.162 HC CDR1
TSGVGVG

SEQ ID NO: 971 - protein, 16 aa, Artificial Sequence
  No.162 HC CDR2
LIDWDDNKYYTTSLKT

SEQ ID NO: 972 - protein, 18 aa, Artificial Sequence
  No.162 HC CDR3
IPGFLRYRNRYYYYGMDV

SEQ ID NO: 973 - protein, 13 aa, Artificial Sequence
  No.163 LC CDR1
SGSSSNIGNNYVS

SEQ ID NO: 974 - protein, 7 aa, Artificial Sequence
  No.163 LC CDR2
DNNKRPS

SEQ ID NO: 975 - protein, 11 aa, Artificial Sequence
  No.163 LC CDR3
GTWDSSLSAGV

SEQ ID NO: 976 - protein, 7 aa, Artificial Sequence
  No.163 HC CDR1
TSGMGVG

SEQ ID NO: 977 - protein, 16 aa, Artificial Sequence
  No.163 HC CDR2
LIDWDDNKYYTTSLKT

SEQ ID NO: 978 - protein, 18 aa, Artificial Sequence
  No.163 HC CDR3
IPGFLRYRNRYYYYGMDV

SEQ ID NO: 979 - protein, 13 aa, Artificial Sequence
  No.164 LC CDR1
SGSSSNIGNNYVS

SEQ ID NO: 980 - protein, 7 aa, Artificial Sequence
  No.164 LC CDR2
DNNKRPS

SEQ ID NO: 981 - protein, 11 aa, Artificial Sequence
  No.164 LC CDR3
GTWDSSLSAGV

SEQ ID NO: 982 - protein, 7 aa, Artificial Sequence
  No.164 HC CDR1
TSGVGVG

SEQ ID NO: 983 - protein, 16 aa, Artificial Sequence
  No.164 HC CDR2
LIDWDDNKYYTTSLKT

SEQ ID NO: 984 - protein, 18 aa, Artificial Sequence
  No.164 HC CDR3
IPGFLRYRNRYYYYGMDV

SEQ ID NO: 985 - protein, 13 aa, Artificial Sequence
  No.165 LC CDR1
SGSSSNIGNNYVS

SEQ ID NO: 986 - protein, 7 aa, Artificial Sequence
  No.165 LC CDR2
DNNKRPS

SEQ ID NO: 987 - protein, 11 aa, Artificial Sequence
  No.165 LC CDR3
GTWDSSLSAGV

SEQ ID NO: 988 - protein, 7 aa, Artificial Sequence
  No.165 HC CDR1
TSGMGVG

SEQ ID NO: 989 - protein, 16 aa, Artificial Sequence
  No.165 HC CDR2
LIDWDDNKYYTTSLKT

SEQ ID NO: 990 - protein, 18 aa, Artificial Sequence
  No.165 HC CDR3
IPGFLRYRNRYYYYGMDV

SEQ ID NO: 991 - protein, 13 aa, Artificial Sequence
  No.166 LC CDR1
SGSSSNIGNNYVS

SEQ ID NO: 992 - protein, 7 aa, Artificial Sequence
  No.166 LC CDR2
DNNKRPS

SEQ ID NO: 993 - protein, 11 aa, Artificial Sequence
  No.166 LC CDR3
GTWDSSLSAGV

SEQ ID NO: 994 - protein, 7 aa, Artificial Sequence
  No.166 HC CDR1
TSGMGVG

SEQ ID NO: 995 - protein, 16 aa, Artificial Sequence
  No.166 HC CDR2
LIDWDDNKYYTTSLKT

SEQ ID NO: 996 - protein, 18 aa, Artificial Sequence
  No.166 HC CDR3
IPGFLRYRNRYYYYGMDV

SEQ ID NO: 997 - protein, 13 aa, Artificial Sequence
  No.167 LC CDR1
SGSSSNIGNNYVS

SEQ ID NO: 998 - protein, 7 aa, Artificial Sequence
  No.167 LC CDR2
DNNKRPS

SEQ ID NO: 999 - protein, 11 aa, Artificial Sequence
  No.167 LC CDR3
GTWDSSLSAGV

SEQ ID NO: 1000 - protein, 7 aa, Artificial Sequence
  No.167 HC CDR1
TSGVGVG

SEQ ID NO: 1001 - protein, 16 aa, Artificial Sequence
  No.167 HC CDR2
LIDWDDNKYYTTSLKT

SEQ ID NO: 1002 - protein, 18 aa, Artificial Sequence
  No.167 HC CDR3
IPGFLRYRNRYYYYGMDV

SEQ ID NO: 1003 - protein, 13 aa, Artificial Sequence
  No.168 LC CDR1
SGSSSNIGNNYVS

SEQ ID NO: 1004 - protein, 7 aa, Artificial Sequence
  No.168 LC CDR2
DNNKRPS

SEQ ID NO: 1005 - protein, 11 aa, Artificial Sequence
  No.168 LC CDR3
GTWDSSLSAGV

SEQ ID NO: 1006 - protein, 7 aa, Artificial Sequence
  No.168 HC CDR1
TSGMGVG

SEQ ID NO: 1007 - protein, 16 aa, Artificial Sequence
  No.168 HC CDR2
LIDWDDNKYYTTSLKT

SEQ ID NO: 1008 - protein, 18 aa, Artificial Sequence
  No.168 HC CDR3
IPGFLRYRNRYYYYGMDV

SEQ ID NO: 1009 - protein, 13 aa, Artificial Sequence
  No.169 LC CDR1
SGSSSNIGKNYVS

SEQ ID NO: 1010 - protein, 7 aa, Artificial Sequence
  No.169 LC CDR2
DNNKRPS

SEQ ID NO: 1011 - protein, 11 aa, Artificial Sequence
  No.169 LC CDR3
GTWDSSLSAVV

SEQ ID NO: 1012 - protein, 7 aa, Artificial Sequence
  No.169 HC CDR1
TSGVGVG

SEQ ID NO: 1013 - protein, 16 aa, Artificial Sequence
  No.169 HC CDR2
LIDWDDNKYYTTSLKT

SEQ ID NO: 1014 - protein, 18 aa, Artificial Sequence
  No.169 HC CDR3
IPGFLRYRNRYYYYGMDV

SEQ ID NO: 1015 - protein, 13 aa, Artificial Sequence
  No.170 LC CDR1
SGSSSNIGNNYVS

SEQ ID NO: 1016 - protein, 7 aa, Artificial Sequence
  No.170 LC CDR2
DNNKRPS

SEQ ID NO: 1017 - protein, 11 aa, Artificial Sequence
  No.170 LC CDR3
GTWDSSLSAGV

SEQ ID NO: 1018 - protein, 7 aa, Artificial Sequence
  No.170 HC CDR1
TSGMGVG

SEQ ID NO: 1019 - protein, 16 aa, Artificial Sequence
  No.170 HC CDR2
LIDWDDNKYYTTSLKT

SEQ ID NO: 1020 - protein, 18 aa, Artificial Sequence
  No.170 HC CDR3
IPGFLRYRNRYYYYGMDV

SEQ ID NO: 1021 - protein, 13 aa, Artificial Sequence
  No.171 LC CDR1
SGRSSNIGNNYVS

SEQ ID NO: 1022 - protein, 7 aa, Artificial Sequence
  No.171 LC CDR2
DNNKRPS

SEQ ID NO: 1023 - protein, 11 aa, Artificial Sequence
  No.171 LC CDR3
GTWDSSLSAGV

SEQ ID NO: 1024 - protein, 7 aa, Artificial Sequence
  No.171 HC CDR1
TSGMGVG

SEQ ID NO: 1025 - protein, 16 aa, Artificial Sequence
  No.171 HC CDR2
LIDWDDNKYYTTSLKT

SEQ ID NO: 1026 - protein, 18 aa, Artificial Sequence
  No.171 HC CDR3
IPGFLRYRNRYYYYGMDV

SEQ ID NO: 1027 - protein, 13 aa, Artificial Sequence
  No.172 LC CDR1
SGSSSNIGNNYVS

SEQ ID NO: 1028 - protein, 7 aa, Artificial Sequence
  No.172 LC CDR2
DNNKRPS

SEQ ID NO: 1029 - protein, 11 aa, Artificial Sequence
  No.172 LC CDR3
GTWDSSLSAGV

SEQ ID NO: 1030 - protein, 7 aa, Artificial Sequence
  No.172 HC CDR1
TSGVGVG

SEQ ID NO: 1031 - protein, 16 aa, Artificial Sequence
  No.172 HC CDR2
LIDWDDNKYYTTSLKT

SEQ ID NO: 1032 - protein, 18 aa, Artificial Sequence
  No.172 HC CDR3
IPGFLRYRNRYYYYGMDV

SEQ ID NO: 1033 - protein, 13 aa, Artificial Sequence
  No.173 LC CDR1
SGSSSNIGNNYVS

SEQ ID NO: 1034 - protein, 7 aa, Artificial Sequence
  No.173 LC CDR2
DNNKRPS

SEQ ID NO: 1035 - protein, 11 aa, Artificial Sequence
  No.173 LC CDR3
GTWDSSLSAGV

SEQ ID NO: 1036 - protein, 7 aa, Artificial Sequence
  No.173 HC CDR1
TSGVGVG

SEQ ID NO: 1037 - protein, 16 aa, Artificial Sequence
  No.173 HC CDR2
LIDWDDNKYYTTSLKT

SEQ ID NO: 1038 - protein, 18 aa, Artificial Sequence
  No.173 HC CDR3
IPGFLRYRNRYYYYGMDV

SEQ ID NO: 1039 - protein, 13 aa, Artificial Sequence
  No.174 LC CDR1
SGSSSNIGNNYVS

SEQ ID NO: 1040 - protein, 7 aa, Artificial Sequence
  No.174 LC CDR2
DNNKRPS

SEQ ID NO: 1041 - protein, 11 aa, Artificial Sequence
  No.174 LC CDR3
GTWDSSLSAGV

SEQ ID NO: 1042 - protein, 7 aa, Artificial Sequence
  No.174 HC CDR1
TSGMGVG

SEQ ID NO: 1043 - protein, 16 aa, Artificial Sequence
  No.174 HC CDR2
LIDWDDNKYYTTSLKT

SEQ ID NO: 1044 - protein, 18 aa, Artificial Sequence
  No.174 HC CDR3
IPGFLRYRNRYYYYGMDV

SEQ ID NO: 1045 - protein, 13 aa, Artificial Sequence
  No.175 LC CDR1
SGSSSNIGNNYVS

SEQ ID NO: 1046 - protein, 7 aa, Artificial Sequence
  No.175 LC CDR2
DNNKRPS

SEQ ID NO: 1047 - protein, 11 aa, Artificial Sequence
  No.175 LC CDR3
GTWDSSLSAGV

SEQ ID NO: 1048 - protein, 7 aa, Artificial Sequence
  No.175 HC CDR1
TSGMGVG

SEQ ID NO: 1049 - protein, 16 aa, Artificial Sequence
  No.175 HC CDR2
LIDWDDNKYYTTSLKT

SEQ ID NO: 1050 - protein, 18 aa, Artificial Sequence
  No.175 HC CDR3
IPGFLRYRNRYYYYGMDV

SEQ ID NO: 1051 - protein, 13 aa, Artificial Sequence
  No.176 LC CDR1
SGSSSNIGNNYVS

SEQ ID NO: 1052 - protein, 7 aa, Artificial Sequence
  No.176 LC CDR2
DNNKRPS

SEQ ID NO: 1053 - protein, 11 aa, Artificial Sequence
  No.176 LC CDR3
GTWDSSLSAGV

SEQ ID NO: 1054 - protein, 7 aa, Artificial Sequence
  No.176 HC CDR1
TSGVGVG

SEQ ID NO: 1055 - protein, 16 aa, Artificial Sequence
  No.176 HC CDR2
LIDWDDNKYYTTSLKT

SEQ ID NO: 1056 - protein, 18 aa, Artificial Sequence
  No.176 HC CDR3
IPGFLRYRNRYYYYGMDV

SEQ ID NO: 1057 - protein, 13 aa, Artificial Sequence
  No.177 LC CDR1
SGSSSNIGNNYVS

SEQ ID NO: 1058 - protein, 7 aa, Artificial Sequence
  No.177 LC CDR2
DNNKRPS

SEQ ID NO: 1059 - protein, 11 aa, Artificial Sequence
  No.177 LC CDR3
GTWDSSLSAGV

SEQ ID NO: 1060 - protein, 7 aa, Artificial Sequence
  No.177 HC CDR1
TSGVGVG

SEQ ID NO: 1061 - protein, 16 aa, Artificial Sequence
  No.177 HC CDR2
LIDWDDNKYYTTSLKT

SEQ ID NO: 1062 - protein, 18 aa, Artificial Sequence
  No.177 HC CDR3
IPGFLRYRNRYYYYGMDV

SEQ ID NO: 1063 - protein, 13 aa, Artificial Sequence
  No.178 LC CDR1
SGSSSNIGNNYVS

SEQ ID NO: 1064 - protein, 7 aa, Artificial Sequence
  No.178 LC CDR2
DNNKRPS

SEQ ID NO: 1065 - protein, 11 aa, Artificial Sequence
  No.178 LC CDR3
GTWDSSLSAGV

SEQ ID NO: 1066 - protein, 7 aa, Artificial Sequence
  No.178 HC CDR1
TSGMGVG

SEQ ID NO: 1067 - protein, 16 aa, Artificial Sequence
  No.178 HC CDR2
LIDWDDNKYYTTSLKT

SEQ ID NO: 1068 - protein, 18 aa, Artificial Sequence
  No.178 HC CDR3
IPGFLRYRNRYYYYGMDV

SEQ ID NO: 1069 - protein, 13 aa, Artificial Sequence
  No.179 LC CDR1
SGSSSNIGNNYVS

SEQ ID NO: 1070 - protein, 7 aa, Artificial Sequence
  No.179 LC CDR2
DNNKRPS

SEQ ID NO: 1071 - protein, 11 aa, Artificial Sequence
  No.179 LC CDR3
GTWDSSLSAGV

SEQ ID NO: 1072 - protein, 7 aa, Artificial Sequence
  No.179 HC CDR1
TSGMGVG

SEQ ID NO: 1073 - protein, 16 aa, Artificial Sequence
  No.179 HC CDR2
LIDWDDNKYYTTSLKT

SEQ ID NO: 1074 - protein, 18 aa, Artificial Sequence
  No.179 HC CDR3
IPGFLRYRNRYYYYGMDV

SEQ ID NO: 1075 - protein, 13 aa, Artificial Sequence
  No.180 LC CDR1
SGSSSNIGNNYVS

SEQ ID NO: 1076 - protein, 7 aa, Artificial Sequence
  No.180 LC CDR2
DNNKRPS

SEQ ID NO: 1077 - protein, 11 aa, Artificial Sequence
  No.180 LC CDR3
GTWDSSLSAGV

SEQ ID NO: 1078 - protein, 7 aa, Artificial Sequence
  No.180 HC CDR1
TSGMGVG

SEQ ID NO: 1079 - protein, 16 aa, Artificial Sequence
  No.180 HC CDR2
LIDWDDNKYYTTSLKT

SEQ ID NO: 1080 - protein, 18 aa, Artificial Sequence
  No.180 HC CDR3
IPGFLRYRNRYYYYGMDV

SEQ ID NO: 1081 - protein, 13 aa, Artificial Sequence
  No.181 LC CDR1
SGSSSNIGNNYVS

SEQ ID NO: 1082 - protein, 7 aa, Artificial Sequence
  No.181 LC CDR2
DNNKRPS

SEQ ID NO: 1083 - protein, 11 aa, Artificial Sequence
  No.181 LC CDR3
GTWDSSLSAGV

SEQ ID NO: 1084 - protein, 7 aa, Artificial Sequence
  No.181 HC CDR1
TSGMGVG

SEQ ID NO: 1085 - protein, 16 aa, Artificial Sequence
  No.181 HC CDR2
LIDWDDNKYYTTSLKT

SEQ ID NO: 1086 - protein, 18 aa, Artificial Sequence
  No.181 HC CDR3
IPGFLRYRNRYYYYGMDV

SEQ ID NO: 1087 - protein, 13 aa, Artificial Sequence
  No.182 LC CDR1
SGSSSNIGNNYVS

SEQ ID NO: 1088 - protein, 7 aa, Artificial Sequence
  No.182 LC CDR2
DNNKRPS

SEQ ID NO: 1089 - protein, 11 aa, Artificial Sequence
  No.182 LC CDR3
GTWDSSLSAGV

SEQ ID NO: 1090 - protein, 7 aa, Artificial Sequence
  No.182 HC CDR1
TSGVGVG

SEQ ID NO: 1091 - protein, 16 aa, Artificial Sequence
  No.182 HC CDR2
LIDWDDNKYYTTSLKT

SEQ ID NO: 1092 - protein, 18 aa, Artificial Sequence
  No.182 HC CDR3
IPGFLRYRNRYYYYGMDV

SEQ ID NO: 1093 - protein, 13 aa, Artificial Sequence
  No.183 LC CDR1
SGSSSNIGNNYVS

SEQ ID NO: 1094 - protein, 7 aa, Artificial Sequence
  No.183 LC CDR2
DNNKRPS

SEQ ID NO: 1095 - protein, 11 aa, Artificial Sequence
  No.183 LC CDR3
GTWDSSLSAGV

SEQ ID NO: 1096 - protein, 7 aa, Artificial Sequence
  No.183 HC CDR1
TSGMGVG

SEQ ID NO: 1097 - protein, 16 aa, Artificial Sequence
  No.183 HC CDR2
LIDWDDNKYYTTSLKT

SEQ ID NO: 1098 - protein, 18 aa, Artificial Sequence
  No.183 HC CDR3
IPGFLRYRNRYYYYGMDV

SEQ ID NO: 1099 - protein, 13 aa, Artificial Sequence
  No.184 LC CDR1
SGSSSNIGDNYVS

SEQ ID NO: 1100 - protein, 7 aa, Artificial Sequence
  No.184 LC CDR2
DNDKRPS

SEQ ID NO: 1101 - protein, 11 aa, Artificial Sequence
  No.184 LC CDR3
GTWDSSLSAVV

SEQ ID NO: 1102 - protein, 7 aa, Artificial Sequence
  No.184 HC CDR1
TSGMGVG

SEQ ID NO: 1103 - protein, 16 aa, Artificial Sequence
  No.184 HC CDR2
LIDWDDNKYYTTSLKT

SEQ ID NO: 1104 - protein, 18 aa, Artificial Sequence
  No.184 HC CDR3
IPGFLRYRNRYYYYGMDV

SEQ ID NO: 1105 - protein, 13 aa, Artificial Sequence
  No.185 LC CDR1
SGSSSNIGNNYVS

SEQ ID NO: 1106 - protein, 7 aa, Artificial Sequence
  No.185 LC CDR2
DNNKRPS

SEQ ID NO: 1107 - protein, 11 aa, Artificial Sequence
  No.185 LC CDR3
GTWDSSLSAGV

SEQ ID NO: 1108 - protein, 7 aa, Artificial Sequence
  No.185 HC CDR1
TSGMGVG

SEQ ID NO: 1109 - protein, 16 aa, Artificial Sequence
  No.185 HC CDR2
LIDWDDNKYYTTSLKT

SEQ ID NO: 1110 - protein, 18 aa, Artificial Sequence
  No.185 HC CDR3
IPGFLRYRNRYYYYGMDV

SEQ ID NO: 1111 - protein, 13 aa, Artificial Sequence
  No.186 LC CDR1
SGRSSNIGNNYVS

SEQ ID NO: 1112 - protein, 7 aa, Artificial Sequence
  No.186 LC CDR2
DNNKRPS

SEQ ID NO: 1113 - protein, 11 aa, Artificial Sequence
  No.186 LC CDR3
GTWDSSLSAGV

SEQ ID NO: 1114 - protein, 7 aa, Artificial Sequence
  No.186 HC CDR1
TSGMGVG

SEQ ID NO: 1115 - protein, 16 aa, Artificial Sequence
  No.186 HC CDR2
LIDWDDNKYYTTSLKT

SEQ ID NO: 1116 - protein, 18 aa, Artificial Sequence
  No.186 HC CDR3
IPGFLRYRNRYYYYGMDV

SEQ ID NO: 1117 - protein, 13 aa, Artificial Sequence
  No.187 LC CDR1
SGSSSNIGNNYVS

SEQ ID NO: 1118 - protein, 7 aa, Artificial Sequence
  No.187 LC CDR2
DNNKRPS

SEQ ID NO: 1119 - protein, 11 aa, Artificial Sequence
  No.187 LC CDR3
GTWDSSLSAGV

SEQ ID NO: 1120 - protein, 7 aa, Artificial Sequence
  No.187 HC CDR1
TSGVGVG

SEQ ID NO: 1121 - protein, 16 aa, Artificial Sequence
  No.187 HC CDR2
LIDWDDNKYYTTSLKT

SEQ ID NO: 1122 - protein, 18 aa, Artificial Sequence
  No.187 HC CDR3
IPGFLRYRNRYYYYGMDV

SEQ ID NO: 1123 - protein, 13 aa, Artificial Sequence
  No.188 LC CDR1
SGSSSNIGNNYVS

SEQ ID NO: 1124 - protein, 7 aa, Artificial Sequence
  No.188 LC CDR2
DNNKRPS

SEQ ID NO: 1125 - protein, 11 aa, Artificial Sequence
  No.188 LC CDR3
GTWDSSLSAGV

SEQ ID NO: 1126 - protein, 7 aa, Artificial Sequence
  No.188 HC CDR1
TSGMGVG

SEQ ID NO: 1127 - protein, 16 aa, Artificial Sequence
  No.188 HC CDR2
LIDWDDNKYYTTSLKT

SEQ ID NO: 1128 - protein, 18 aa, Artificial Sequence
  No.188 HC CDR3
IPGFLRYRNRYYYYGMDV

SEQ ID NO: 1129 - protein, 13 aa, Artificial Sequence
  No.189 LC CDR1
SGRSSNIGNNYVS

SEQ ID NO: 1130 - protein, 7 aa, Artificial Sequence
  No.189 LC CDR2
DNNKRPS

SEQ ID NO: 1131 - protein, 11 aa, Artificial Sequence
  No.189 LC CDR3
GTWDSSLSAGV

SEQ ID NO: 1132 - protein, 7 aa, Artificial Sequence
  No.189 HC CDR1
TSGMGVG

SEQ ID NO: 1133 - protein, 16 aa, Artificial Sequence
  No.189 HC CDR2
LIDWDDNKYYTTSLKT

SEQ ID NO: 1134 - protein, 18 aa, Artificial Sequence
  No.189 HC CDR3
IPGFLRYRNRYYYYGMDV

SEQ ID NO: 1135 - protein, 13 aa, Artificial Sequence
  No.190 LC CDR1
SGSSSNIGNNYVS

SEQ ID NO: 1136 - protein, 7 aa, Artificial Sequence
  No.190 LC CDR2
DNNKRPS

SEQ ID NO: 1137 - protein, 11 aa, Artificial Sequence
  No.190 LC CDR3
GTWDSSLSAGV

SEQ ID NO: 1138 - protein, 7 aa, Artificial Sequence
  No.190 HC CDR1
TSGVGVG

SEQ ID NO: 1139 - protein, 16 aa, Artificial Sequence
  No.190 HC CDR2
LIDWDDNKYYTTSLKT

SEQ ID NO: 1140 - protein, 18 aa, Artificial Sequence
  No.190 HC CDR3
IPGFLRYRNRYYYYGMDV

SEQ ID NO: 1141 - protein, 13 aa, Artificial Sequence
  No.191 LC CDR1
SGSSSNIGNNYVS

SEQ ID NO: 1142 - protein, 7 aa, Artificial Sequence
  No.191 LC CDR2
DNNKRPS

SEQ ID NO: 1143 - protein, 11 aa, Artificial Sequence
  No.191 LC CDR3
GTWDSSLSAGV

SEQ ID NO: 1144 - protein, 7 aa, Artificial Sequence
  No.191 HC CDR1
TSGMGVG

SEQ ID NO: 1145 - protein, 16 aa, Artificial Sequence
  No.191 HC CDR2
LIDWDDNKYYTTSLKT

SEQ ID NO: 1146 - protein, 18 aa, Artificial Sequence
  No.191 HC CDR3
IPGFLRYRNRYYYYGMDV

SEQ ID NO: 1147 - protein, 13 aa, Artificial Sequence
  No.192 LC CDR1
SGSSSNIGNNYVS

SEQ ID NO: 1148 - protein, 7 aa, Artificial Sequence
  No.192 LC CDR2
DNNKRPS

SEQ ID NO: 1149 - protein, 11 aa, Artificial Sequence
  No.192 LC CDR3
GTWDSSLSAGV

SEQ ID NO: 1150 - protein, 7 aa, Artificial Sequence
  No.192 HC CDR1
TSGMGVG

SEQ ID NO: 1151 - protein, 16 aa, Artificial Sequence
  No.192 HC CDR2
LIDWDDNKYYTTSLKT

SEQ ID NO: 1152 - protein, 18 aa, Artificial Sequence
  No.192 HC CDR3
IPGFLRYRNRYYYYGMDV

SEQ ID NO: 1153 - protein, 13 aa, Artificial Sequence
  No.193 LC CDR1
SGSSSNIGNNYVS

SEQ ID NO: 1154 - protein, 7 aa, Artificial Sequence
  No.193 LC CDR2
DNNKRPS

SEQ ID NO: 1155 - protein, 11 aa, Artificial Sequence
  No.193 LC CDR3
GTWDSSLSAGV

SEQ ID NO: 1156 - protein, 7 aa, Artificial Sequence
  No.193 HC CDR1
TSGMGVG

SEQ ID NO: 1157 - protein, 16 aa, Artificial Sequence
  No.193 HC CDR2
LIDWDDNKYYTTSLKT

SEQ ID NO: 1158 - protein, 18 aa, Artificial Sequence
  No.193 HC CDR3
IPGFLRYRNRYYYYGMDV

SEQ ID NO: 1159 - protein, 13 aa, Artificial Sequence
  No.194 LC CDR1
SGSSSNIGNNYVS

SEQ ID NO: 1160 - protein, 7 aa, Artificial Sequence
  No.194 LC CDR2
DNNKRPS

SEQ ID NO: 1161 - protein, 11 aa, Artificial Sequence
  No.194 LC CDR3
GTWDSSLSAGV

SEQ ID NO: 1162 - protein, 7 aa, Artificial Sequence
  No.194 HC CDR1
TSGMGVG

SEQ ID NO: 1163 - protein, 16 aa, Artificial Sequence
  No.194 HC CDR2
LIDWDDNKYYTTSLKT

SEQ ID NO: 1164 - protein, 18 aa, Artificial Sequence
  No.194 HC CDR3
IPGFLRYRNRYYYYGMDV

SEQ ID NO: 1165 - protein, 13 aa, Artificial Sequence
  No.195 LC CDR1
TRSSGSIASNYVQ

SEQ ID NO: 1166 - protein, 7 aa, Artificial Sequence
  No.195 LC CDR2
EDNQRPS

SEQ ID NO: 1167 - protein, 9 aa, Artificial Sequence
  No.195 LC CDR3
QSYDSSDWV

SEQ ID NO: 1168 - protein, 5 aa, Artificial Sequence
  No.195 HC CDR1
RYGIS

SEQ ID NO: 1169 - protein, 17 aa, Artificial Sequence
  No.195 HC CDR2
WISAYNGNTKYAQKLQG

SEQ ID NO: 1170 - protein, 11 aa, Artificial Sequence
  No.195 HC CDR3
VLGIAVAGTPI

SEQ ID NO: 1171 - protein, 14 aa, Artificial Sequence
  No.196 LC CDR1
TGSSSNIGAGYDVH

SEQ ID NO: 1172 - protein, 7 aa, Artificial Sequence
  No.196 LC CDR2
GNSNRPS

SEQ ID NO: 1173 - protein, 11 aa, Artificial Sequence
  No.196 LC CDR3
QSYDSSLSGSV

SEQ ID NO: 1174 - protein, 5 aa, Artificial Sequence
  No.196 HC CDR1
SYAIS

SEQ ID NO: 1175 - protein, 17 aa, Artificial Sequence
  No.196 HC CDR2
RIIPILGIANYAQKFQG

SEQ ID NO: 1176 - protein, 15 aa, Artificial Sequence
  No.196 HC CDR3
VRGYSGYGSTYYFDY

SEQ ID NO: 1177 - protein, 14 aa, Artificial Sequence
  No.197 LC CDR1
TGSSSNIGAGYDVH

SEQ ID NO: 1178 - protein, 7 aa, Artificial Sequence
  No.197 LC CDR2
GNSNRPS

SEQ ID NO: 1179 - protein, 11 aa, Artificial Sequence
  No.197 LC CDR3
QSYDSSLSGSI

SEQ ID NO: 1180 - protein, 5 aa, Artificial Sequence
  No.197 HC CDR1
SYAIS

SEQ ID NO: 1181 - protein, 17 aa, Artificial Sequence
  No.197 HC CDR2
GIIPILGIANYAQKFQG

SEQ ID NO: 1182 - protein, 15 aa, Artificial Sequence
  No.197 HC CDR3
VRGYSGYGSTYYFDY

SEQ ID NO: 1183 - protein, 14 aa, Artificial Sequence
  No.198 LC CDR1
TGSSSNIGAGYDVH

SEQ ID NO: 1184 - protein, 7 aa, Artificial Sequence
  No.198 LC CDR2
GNSNRPS

SEQ ID NO: 1185 - protein, 11 aa, Artificial Sequence
  No.198 LC CDR3
QSYDSSLSGSV

SEQ ID NO: 1186 - protein, 5 aa, Artificial Sequence
  No.198 HC CDR1
SYAIS

SEQ ID NO: 1187 - protein, 17 aa, Artificial Sequence
  No.198 HC CDR2
RIIPILGIANYAQKFQG

SEQ ID NO: 1188 - protein, 15 aa, Artificial Sequence
  No.198 HC CDR3
VRGYSGYGSTYYFDY

SEQ ID NO: 1189 - protein, 14 aa, Artificial Sequence
  No.199 LC CDR1
TGSSSNIGAGYDVH

SEQ ID NO: 1190 - protein, 7 aa, Artificial Sequence
  No.199 LC CDR2
GNSNRPS

SEQ ID NO: 1191 - protein, 11 aa, Artificial Sequence
  No.199 LC CDR3
QSYDSSLSGSI

SEQ ID NO: 1192 - protein, 5 aa, Artificial Sequence
  No.199 HC CDR1
SYAIS

SEQ ID NO: 1193 - protein, 17 aa, Artificial Sequence
  No.199 HC CDR2
GIIPILGIANYAQKFQG

SEQ ID NO: 1194 - protein, 15 aa, Artificial Sequence
  No.199 HC CDR3
VRGYSGYGSTYYFDY

SEQ ID NO: 1195 - protein, 14 aa, Artificial Sequence
  No.200 LC CDR1
TGSSSNIGAGYDVH

SEQ ID NO: 1196 - protein, 7 aa, Artificial Sequence
  No.200 LC CDR2
GNSNRPS

SEQ ID NO: 1197 - protein, 11 aa, Artificial Sequence
  No.200 LC CDR3
QSYDSSLSGSV

SEQ ID NO: 1198 - protein, 5 aa, Artificial Sequence
  No.200 HC CDR1
SYAIS

SEQ ID NO: 1199 - protein, 17 aa, Artificial Sequence
  No.200 HC CDR2
RIIPILGIANYAQKFQG

SEQ ID NO: 1200 - protein, 15 aa, Artificial Sequence
  No.200 HC CDR3
VRGYSGYGSTYYFDY

SEQ ID NO: 1201 - protein, 14 aa, Artificial Sequence
  No.201 LC CDR1
TGSSSNIGAGYDVH

SEQ ID NO: 1202 - protein, 7 aa, Artificial Sequence
  No.201 LC CDR2
GNSNRPS

SEQ ID NO: 1203 - protein, 11 aa, Artificial Sequence
  No.201 LC CDR3
QSYDSSLSGSV

SEQ ID NO: 1204 - protein, 5 aa, Artificial Sequence
  No.201 HC CDR1
SYAIS

SEQ ID NO: 1205 - protein, 17 aa, Artificial Sequence
  No.201 HC CDR2
RIIPILGIANYAQKFQG

SEQ ID NO: 1206 - protein, 15 aa, Artificial Sequence
  No.201 HC CDR3
VRGYSGYGSTYYSDY

SEQ ID NO: 1207 - protein, 14 aa, Artificial Sequence
  No.202 LC CDR1
TGSSSNIGAGYDVH

SEQ ID NO: 1208 - protein, 7 aa, Artificial Sequence
  No.202 LC CDR2
GNSNRPS

SEQ ID NO: 1209 - protein, 11 aa, Artificial Sequence
  No.202 LC CDR3
QSYDSSLSGSV

SEQ ID NO: 1210 - protein, 5 aa, Artificial Sequence
  No.202 HC CDR1
SYAIS

SEQ ID NO: 1211 - protein, 17 aa, Artificial Sequence
  No.202 HC CDR2
RIIPILGIANYAQKFQG

SEQ ID NO: 1212 - protein, 15 aa, Artificial Sequence
  No.202 HC CDR3
VRGYSGYGSTYYSDY

SEQ ID NO: 1213 - protein, 13 aa, Artificial Sequence
  No.203 LC CDR1
SGSSSNIGSNTVN

SEQ ID NO: 1214 - protein, 7 aa, Artificial Sequence
  No.203 LC CDR2
SNNQRPS

SEQ ID NO: 1215 - protein, 11 aa, Artificial Sequence
  No.203 LC CDR3
AAWDDSLNGYV

SEQ ID NO: 1216 - protein, 5 aa, Artificial Sequence
  No.203 HC CDR1
RFAMH

SEQ ID NO: 1217 - protein, 17 aa, Artificial Sequence
  No.203 HC CDR2
VVSYDGSNNYYADSVKG

SEQ ID NO: 1218 - protein, 18 aa, Artificial Sequence
  No.203 HC CDR3
GDYYGSGSYYNPSPFFDY

SEQ ID NO: 1219 - protein, 13 aa, Artificial Sequence
  No.204 LC CDR1
SGSSSNIGSKTVN

SEQ ID NO: 1220 - protein, 7 aa, Artificial Sequence
  No.204 LC CDR2
SNNQRPS

SEQ ID NO: 1221 - protein, 11 aa, Artificial Sequence
  No.204 LC CDR3
ATWDDSLNGWV

SEQ ID NO: 1222 - protein, 5 aa, Artificial Sequence
  No.204 HC CDR1
RFAMH

SEQ ID NO: 1223 - protein, 17 aa, Artificial Sequence
  No.204 HC CDR2
VVSYDGSNNYYADSVKG

SEQ ID NO: 1224 - protein, 18 aa, Artificial Sequence
  No.204 HC CDR3
GDYYGSGSYYNPSPFFDY

SEQ ID NO: 1225 - protein, 13 aa, Artificial Sequence
  No.205 LC CDR1
SGSSSNIGSNTVN

SEQ ID NO: 1226 - protein, 7 aa, Artificial Sequence
  No.205 LC CDR2
SNNQRPS

SEQ ID NO: 1227 - protein, 11 aa, Artificial Sequence
  No.205 LC CDR3
ATWDDSLNGWV

SEQ ID NO: 1228 - protein, 5 aa, Artificial Sequence
  No.205 HC CDR1
SFAMH

SEQ ID NO: 1229 - protein, 17 aa, Artificial Sequence
  No.205 HC CDR2
VISFDGSNKYYADSVKG

SEQ ID NO: 1230 - protein, 18 aa, Artificial Sequence
  No.205 HC CDR3
GDYYGSGSYYNPSPFFDY

SEQ ID NO: 1231 - protein, 13 aa, Artificial Sequence
  No.206 LC CDR1
SGSSSNIGSNTVN

SEQ ID NO: 1232 - protein, 7 aa, Artificial Sequence
  No.206 LC CDR2
SNNQRPS

SEQ ID NO: 1233 - protein, 11 aa, Artificial Sequence
  No.206 LC CDR3
AAWDDSLNGWV

SEQ ID NO: 1234 - protein, 5 aa, Artificial Sequence
  No.206 HC CDR1
NFAMH

SEQ ID NO: 1235 - protein, 17 aa, Artificial Sequence
  No.206 HC CDR2
VISYDGSNKYYADSVKG

SEQ ID NO: 1236 - protein, 18 aa, Artificial Sequence
  No.206 HC CDR3
GDYYGSGSYYNPSPFFDY

SEQ ID NO: 1237 - protein, 13 aa, Artificial Sequence
  No.207 LC CDR1
SGSSSNIGSNTVN

SEQ ID NO: 1238 - protein, 7 aa, Artificial Sequence
  No.207 LC CDR2
SNNQRPS

SEQ ID NO: 1239 - protein, 11 aa, Artificial Sequence
  No.207 LC CDR3
ATWDDALSGWV

SEQ ID NO: 1240 - protein, 5 aa, Artificial Sequence
  No.207 HC CDR1
RFAMH

SEQ ID NO: 1241 - protein, 17 aa, Artificial Sequence
  No.207 HC CDR2
VVSYDGSNNYYADSVKG

SEQ ID NO: 1242 - protein, 18 aa, Artificial Sequence
  No.207 HC CDR3
GDYYGSGSYYNPSPFFDY

SEQ ID NO: 1243 - protein, 13 aa, Artificial Sequence
  No.208 LC CDR1
SGSSSNIGSNTVN

SEQ ID NO: 1244 - protein, 7 aa, Artificial Sequence
  No.208 LC CDR2
SNNQRPS

SEQ ID NO: 1245 - protein, 11 aa, Artificial Sequence
  No.208 LC CDR3
AAWDDSLNGWV

SEQ ID NO: 1246 - protein, 5 aa, Artificial Sequence
  No.208 HC CDR1
RFAMH

SEQ ID NO: 1247 - protein, 17 aa, Artificial Sequence
  No.208 HC CDR2
VVSYDGSNNYYADSVKG

SEQ ID NO: 1248 - protein, 18 aa, Artificial Sequence
  No.208 HC CDR3
GDYYGSGSYYNPSPFFDY

SEQ ID NO: 1249 - protein, 13 aa, Artificial Sequence
  No.209 LC CDR1
SGSSSNIGSKAVN

SEQ ID NO: 1250 - protein, 7 aa, Artificial Sequence
  No.209 LC CDR2
SNNQRPS

SEQ ID NO: 1251 - protein, 11 aa, Artificial Sequence
  No.209 LC CDR3
ATWDDSLNGWV

SEQ ID NO: 1252 - protein, 5 aa, Artificial Sequence
  No.209 HC CDR1
SFAMH

SEQ ID NO: 1253 - protein, 17 aa, Artificial Sequence
  No.209 HC CDR2
VISYDGSNKYYADSVKG

SEQ ID NO: 1254 - protein, 18 aa, Artificial Sequence
  No.209 HC CDR3
GDYYGSGSYYNPSPFFDY

SEQ ID NO: 1255 - protein, 13 aa, Artificial Sequence
  No.210 LC CDR1
SGSSSNIGSNTVN

SEQ ID NO: 1256 - protein, 7 aa, Artificial Sequence
  No.210 LC CDR2
SNNQRPS

SEQ ID NO: 1257 - protein, 11 aa, Artificial Sequence
  No.210 LC CDR3
AAWDDSLNGWV

SEQ ID NO: 1258 - protein, 5 aa, Artificial Sequence
  No.210 HC CDR1
RFAMH

SEQ ID NO: 1259 - protein, 17 aa, Artificial Sequence
  No.210 HC CDR2
VVSYDGSNNYYADSVKG

SEQ ID NO: 1260 - protein, 18 aa, Artificial Sequence
  No.210 HC CDR3
GDYYGSGSYYNPSPFFDY

SEQ ID NO: 1261 - protein, 13 aa, Artificial Sequence
  No.211 LC CDR1
SGSRSNIGGNTVN

SEQ ID NO: 1262 - protein, 7 aa, Artificial Sequence
  No.211 LC CDR2
GDNQRPS

SEQ ID NO: 1263 - protein, 11 aa, Artificial Sequence
  No.211 LC CDR3
AAWDDSLSGWV

SEQ ID NO: 1264 - protein, 5 aa, Artificial Sequence
  No.211 HC CDR1
TYSMH

SEQ ID NO: 1265 - protein, 17 aa, Artificial Sequence
  No.211 HC CDR2
VISYDGSNKYYADSVKG

SEQ ID NO: 1266 - protein, 18 aa, Artificial Sequence
  No.211 HC CDR3
GDYYGSGSYYNPSPFFDY

SEQ ID NO: 1267 - protein, 13 aa, Artificial Sequence
  No.212 LC CDR1
SGSSSNIGSNTVN

SEQ ID NO: 1268 - protein, 7 aa, Artificial Sequence
  No.212 LC CDR2
SNNQRPS

SEQ ID NO: 1269 - protein, 11 aa, Artificial Sequence
  No.212 LC CDR3
AAWEDSLNGYV

SEQ ID NO: 1270 - protein, 5 aa, Artificial Sequence
  No.212 HC CDR1
NFAMH

SEQ ID NO: 1271 - protein, 17 aa, Artificial Sequence
  No.212 HC CDR2
VISYDGSNKYYADSVKG

SEQ ID NO: 1272 - protein, 18 aa, Artificial Sequence
  No.212 HC CDR3
GDYYGSGSYYNPSPFFDY

SEQ ID NO: 1273 - protein, 13 aa, Artificial Sequence
  No.213 LC CDR1
SGSSSNIGSNTVN

SEQ ID NO: 1274 - protein, 7 aa, Artificial Sequence
  No.213 LC CDR2
SNNQRPS

SEQ ID NO: 1275 - protein, 11 aa, Artificial Sequence
  No.213 LC CDR3
AAWDDSLSGWV

SEQ ID NO: 1276 - protein, 5 aa, Artificial Sequence
  No.213 HC CDR1
RFAMH

SEQ ID NO: 1277 - protein, 17 aa, Artificial Sequence
  No.213 HC CDR2
VVSYDGSNNYYADSVKG

SEQ ID NO: 1278 - protein, 18 aa, Artificial Sequence
  No.213 HC CDR3
GDYYGSGSYYNPSPFFDY

SEQ ID NO: 1279 - protein, 13 aa, Artificial Sequence
  No.214 LC CDR1
SGSSSNIGSNTVN

SEQ ID NO: 1280 - protein, 7 aa, Artificial Sequence
  No.214 LC CDR2
SNNQRPS

SEQ ID NO: 1281 - protein, 11 aa, Artificial Sequence
  No.214 LC CDR3
ATWDDTLDSWV

SEQ ID NO: 1282 - protein, 5 aa, Artificial Sequence
  No.214 HC CDR1
NFAMH

SEQ ID NO: 1283 - protein, 17 aa, Artificial Sequence
  No.214 HC CDR2
VISYDGSNKYYADSVKG

SEQ ID NO: 1284 - protein, 18 aa, Artificial Sequence
  No.214 HC CDR3
GDYYGSGSYYNPSPFFDY

SEQ ID NO: 1285 - protein, 13 aa, Artificial Sequence
  No.215 LC CDR1
SGSSSNIGSNTVN

SEQ ID NO: 1286 - protein, 7 aa, Artificial Sequence
  No.215 LC CDR2
SNNQRPS

SEQ ID NO: 1287 - protein, 11 aa, Artificial Sequence
  No.215 LC CDR3
AAWDDSLNGYV

SEQ ID NO: 1288 - protein, 5 aa, Artificial Sequence
  No.215 HC CDR1
SFAMH

SEQ ID NO: 1289 - protein, 17 aa, Artificial Sequence
  No.215 HC CDR2
VISFDGSNKYYADSVKG

SEQ ID NO: 1290 - protein, 18 aa, Artificial Sequence
  No.215 HC CDR3
GDYYGSGSYYNPSPFFDY

SEQ ID NO: 1291 - protein, 13 aa, Artificial Sequence
  No.216 LC CDR1
SGSSSNIGSNTVN

SEQ ID NO: 1292 - protein, 7 aa, Artificial Sequence
  No.216 LC CDR2
SNNQRPS

SEQ ID NO: 1293 - protein, 11 aa, Artificial Sequence
  No.216 LC CDR3
AAWDDSLNGWV

SEQ ID NO: 1294 - protein, 5 aa, Artificial Sequence
  No.216 HC CDR1
SFAMH

SEQ ID NO: 1295 - protein, 17 aa, Artificial Sequence
  No.216 HC CDR2
VISYDGSNKYYADSVKG

SEQ ID NO: 1296 - protein, 18 aa, Artificial Sequence
  No.216 HC CDR3
GDYYGSGSYYNPSPFFDY

SEQ ID NO: 1297 - protein, 13 aa, Artificial Sequence
  No.217 LC CDR1
SGSSSNIGSNTVN

SEQ ID NO: 1298 - protein, 7 aa, Artificial Sequence
  No.217 LC CDR2
SNNQRPS

SEQ ID NO: 1299 - protein, 11 aa, Artificial Sequence
  No.217 LC CDR3
AAWDDSLNVWV

SEQ ID NO: 1300 - protein, 5 aa, Artificial Sequence
  No.217 HC CDR1
RFAMH

SEQ ID NO: 1301 - protein, 17 aa, Artificial Sequence
  No.217 HC CDR2
VVSYDGSNNYYADSVKG

SEQ ID NO: 1302 - protein, 18 aa, Artificial Sequence
  No.217 HC CDR3
GDYYGSGSYYNPSPFFDY

SEQ ID NO: 1303 - protein, 13 aa, Artificial Sequence
  No.218 LC CDR1
SGSTSNIGSNPVN

SEQ ID NO: 1304 - protein, 7 aa, Artificial Sequence
  No.218 LC CDR2
SNNQRPS

SEQ ID NO: 1305 - protein, 11 aa, Artificial Sequence
  No.218 LC CDR3
AAWDDSLNGWV

SEQ ID NO: 1306 - protein, 5 aa, Artificial Sequence
  No.218 HC CDR1
SFAMH

SEQ ID NO: 1307 - protein, 17 aa, Artificial Sequence
  No.218 HC CDR2
VISFDGSNKYYADSVKG

SEQ ID NO: 1308 - protein, 18 aa, Artificial Sequence
  No.218 HC CDR3
GDYYGSGSYYNPSPFFDY

SEQ ID NO: 1309 - protein, 13 aa, Artificial Sequence
  No.219 LC CDR1
SGSSSNIGSNTVN

SEQ ID NO: 1310 - protein, 7 aa, Artificial Sequence
  No.219 LC CDR2
SNSQRPS

SEQ ID NO: 1311 - protein, 11 aa, Artificial Sequence
  No.219 LC CDR3
AGWDDSLNGWV

SEQ ID NO: 1312 - protein, 5 aa, Artificial Sequence
  No.219 HC CDR1
RFAMH

SEQ ID NO: 1313 - protein, 17 aa, Artificial Sequence
  No.219 HC CDR2
VVSYDGSNNYYADSVKG

SEQ ID NO: 1314 - protein, 18 aa, Artificial Sequence
  No.219 HC CDR3
GDYYGSGSYYNPSPFFDY

SEQ ID NO: 1315 - protein, 13 aa, Artificial Sequence
  No.220 LC CDR1
SGSSSNIGSNTVN

SEQ ID NO: 1316 - protein, 7 aa, Artificial Sequence
  No.220 LC CDR2
SNNQRPS

SEQ ID NO: 1317 - protein, 11 aa, Artificial Sequence
  No.220 LC CDR3
AAWDDSLNGWV

SEQ ID NO: 1318 - protein, 5 aa, Artificial Sequence
  No.220 HC CDR1
NFAMH

SEQ ID NO: 1319 - protein, 17 aa, Artificial Sequence
  No.220 HC CDR2
VISYDGSNKYFADSVKG

SEQ ID NO: 1320 - protein, 18 aa, Artificial Sequence
  No.220 HC CDR3
GDYYGSGSYYNPSPFFDY

SEQ ID NO: 1321 - protein, 13 aa, Artificial Sequence
  No.221 LC CDR1
SGSSSNIGSNTVN

SEQ ID NO: 1322 - protein, 7 aa, Artificial Sequence
  No.221 LC CDR2
SNNQRPS

SEQ ID NO: 1323 - protein, 11 aa, Artificial Sequence
  No.221 LC CDR3
ATWDDSLSGWV

SEQ ID NO: 1324 - protein, 5 aa, Artificial Sequence
  No.221 HC CDR1
RFAMH

SEQ ID NO: 1325 - protein, 17 aa, Artificial Sequence
  No.221 HC CDR2
VVSYDGSNNYYADSVKG

SEQ ID NO: 1326 - protein, 18 aa, Artificial Sequence
  No.221 HC CDR3
GDYYGSGSYYNPSPFFDY

SEQ ID NO: 1327 - protein, 13 aa, Artificial Sequence
  No.222 LC CDR1
SGSSSNIGSNTVN

SEQ ID NO: 1328 - protein, 7 aa, Artificial Sequence
  No.222 LC CDR2
SNNQRPS

SEQ ID NO: 1329 - protein, 11 aa, Artificial Sequence
  No.222 LC CDR3
ATWDDALSGWV

SEQ ID NO: 1330 - protein, 5 aa, Artificial Sequence
  No.222 HC CDR1
RFAMH

SEQ ID NO: 1331 - protein, 17 aa, Artificial Sequence
  No.222 HC CDR2
VVSYDGSNNYYADSVKG

SEQ ID NO: 1332 - protein, 18 aa, Artificial Sequence
  No.222 HC CDR3
GDYYGSGSYYNPSPFFDY

SEQ ID NO: 1333 - protein, 13 aa, Artificial Sequence
  No.223 LC CDR1
SGSSSNIGSNTVN

SEQ ID NO: 1334 - protein, 7 aa, Artificial Sequence
  No.223 LC CDR2
SNNQRPS

SEQ ID NO: 1335 - protein, 11 aa, Artificial Sequence
  No.223 LC CDR3
AAWDDSLNGWV

SEQ ID NO: 1336 - protein, 5 aa, Artificial Sequence
  No.223 HC CDR1
RFAMH

SEQ ID NO: 1337 - protein, 17 aa, Artificial Sequence
  No.223 HC CDR2
VVSYDGSNNYYADSVKG

SEQ ID NO: 1338 - protein, 18 aa, Artificial Sequence
  No.223 HC CDR3
GDYYGSGSYYNPSPFFDY

SEQ ID NO: 1339 - protein, 13 aa, Artificial Sequence
  No.224 LC CDR1
SGSSSNIGSNTVN

SEQ ID NO: 1340 - protein, 7 aa, Artificial Sequence
  No.224 LC CDR2
SNNQRPS

SEQ ID NO: 1341 - protein, 11 aa, Artificial Sequence
  No.224 LC CDR3
ATWDSSLSAWV

SEQ ID NO: 1342 - protein, 5 aa, Artificial Sequence
  No.224 HC CDR1
SYSMH

SEQ ID NO: 1343 - protein, 17 aa, Artificial Sequence
  No.224 HC CDR2
VISYDGSNKYYADSVKG

SEQ ID NO: 1344 - protein, 18 aa, Artificial Sequence
  No.224 HC CDR3
GDYYGSGSYYNPSPFFDY

SEQ ID NO: 1345 - protein, 13 aa, Artificial Sequence
  No.225 LC CDR1
SGSSSNIGSNTVN

SEQ ID NO: 1346 - protein, 7 aa, Artificial Sequence
  No.225 LC CDR2
SNNQRPS

SEQ ID NO: 1347 - protein, 11 aa, Artificial Sequence
  No.225 LC CDR3
AAWDDSLNGWV

SEQ ID NO: 1348 - protein, 5 aa, Artificial Sequence
  No.225 HC CDR1
TYSMH

SEQ ID NO: 1349 - protein, 17 aa, Artificial Sequence
  No.225 HC CDR2
VISYDGSNKYYADSVKG

SEQ ID NO: 1350 - protein, 18 aa, Artificial Sequence
  No.225 HC CDR3
GDYYGSGSYYNPSPFFDY

SEQ ID NO: 1351 - protein, 13 aa, Artificial Sequence
  No.226 LC CDR1
SGSSSNIGSNTVN

SEQ ID NO: 1352 - protein, 7 aa, Artificial Sequence
  No.226 LC CDR2
SNNQRPS

SEQ ID NO: 1353 - protein, 11 aa, Artificial Sequence
  No.226 LC CDR3
AAWDDSLNGWV

SEQ ID NO: 1354 - protein, 5 aa, Artificial Sequence
  No.226 HC CDR1
NFAMH

SEQ ID NO: 1355 - protein, 17 aa, Artificial Sequence
  No.226 HC CDR2
VISYDGSNKYFADSVKG

SEQ ID NO: 1356 - protein, 18 aa, Artificial Sequence
  No.226 HC CDR3
GDYYGSGSYYNPSPFFDY

SEQ ID NO: 1357 - protein, 13 aa, Artificial Sequence
  No.227 LC CDR1
SGSSSNIGSNTVN

SEQ ID NO: 1358 - protein, 7 aa, Artificial Sequence
  No.227 LC CDR2
SNNQRPS

SEQ ID NO: 1359 - protein, 11 aa, Artificial Sequence
  No.227 LC CDR3
AAWDDSLNGWV

SEQ ID NO: 1360 - protein, 5 aa, Artificial Sequence
  No.227 HC CDR1
NFAMH

SEQ ID NO: 1361 - protein, 17 aa, Artificial Sequence
  No.227 HC CDR2
VISYDGSNKYYADSVKG

SEQ ID NO: 1362 - protein, 18 aa, Artificial Sequence
  No.227 HC CDR3
GDYYGSGSYYNPSPFFDY

SEQ ID NO: 1363 - protein, 13 aa, Artificial Sequence
  No.228 LC CDR1
SGSSSNVGSNTVN

SEQ ID NO: 1364 - protein, 7 aa, Artificial Sequence
  No.228 LC CDR2
SNDQRPS

SEQ ID NO: 1365 - protein, 11 aa, Artificial Sequence
  No.228 LC CDR3
ATWDDSLNGWV

SEQ ID NO: 1366 - protein, 5 aa, Artificial Sequence
  No.228 HC CDR1
SFAMH

SEQ ID NO: 1367 - protein, 17 aa, Artificial Sequence
  No.228 HC CDR2
VISFDGSNKYYADSVKG

SEQ ID NO: 1368 - protein, 18 aa, Artificial Sequence
  No.228 HC CDR3
GDYYGSGSYYNPSPFFDY

SEQ ID NO: 1369 - protein, 13 aa, Artificial Sequence
  No.229 LC CDR1
SGSSSNIGSNTVN

SEQ ID NO: 1370 - protein, 7 aa, Artificial Sequence
  No.229 LC CDR2
SNNQRPS

SEQ ID NO: 1371 - protein, 11 aa, Artificial Sequence
  No.229 LC CDR3
AAWDDSLSGWV

SEQ ID NO: 1372 - protein, 5 aa, Artificial Sequence
  No.229 HC CDR1
RFAMH

SEQ ID NO: 1373 - protein, 17 aa, Artificial Sequence
  No.229 HC CDR2
VVSYDGSNNYYADSVKG

SEQ ID NO: 1374 - protein, 18 aa, Artificial Sequence
  No.229 HC CDR3
GDYYGSGSYYNPSPFFDY

SEQ ID NO: 1375 - protein, 13 aa, Artificial Sequence
  No.230 LC CDR1
SGSSSNIGSNTVN

SEQ ID NO: 1376 - protein, 7 aa, Artificial Sequence
  No.230 LC CDR2
SSNQRPS

SEQ ID NO: 1377 - protein, 11 aa, Artificial Sequence
  No.230 LC CDR3
AAWDDSLNGWV

SEQ ID NO: 1378 - protein, 5 aa, Artificial Sequence
  No.230 HC CDR1
NFAMH

SEQ ID NO: 1379 - protein, 17 aa, Artificial Sequence
  No.230 HC CDR2
VISYDGSNKYYADSVKG

SEQ ID NO: 1380 - protein, 18 aa, Artificial Sequence
  No.230 HC CDR3
GDYYGSGSYYNPSPFFDY

SEQ ID NO: 1381 - protein, 13 aa, Artificial Sequence
  No.231 LC CDR1
SGSSSNIGSNTVN

SEQ ID NO: 1382 - protein, 7 aa, Artificial Sequence
  No.231 LC CDR2
SNNQRPS

SEQ ID NO: 1383 - protein, 11 aa, Artificial Sequence
  No.231 LC CDR3
ATWDDSLNGWV

SEQ ID NO: 1384 - protein, 5 aa, Artificial Sequence
  No.231 HC CDR1
SFAMH

SEQ ID NO: 1385 - protein, 17 aa, Artificial Sequence
  No.231 HC CDR2
VISFDGSNKYYADSVKG

SEQ ID NO: 1386 - protein, 18 aa, Artificial Sequence
  No.231 HC CDR3
GDYYGSGSYYNPSPFFDY

SEQ ID NO: 1387 - protein, 13 aa, Artificial Sequence
  No.232 LC CDR1
SGSSSNIGSNTVN

SEQ ID NO: 1388 - protein, 7 aa, Artificial Sequence
  No.232 LC CDR2
SNNQRPS

SEQ ID NO: 1389 - protein, 11 aa, Artificial Sequence
  No.232 LC CDR3
AAWDDSLNAWV

SEQ ID NO: 1390 - protein, 5 aa, Artificial Sequence
  No.232 HC CDR1
SYSMH

SEQ ID NO: 1391 - protein, 17 aa, Artificial Sequence
  No.232 HC CDR2
VISYDGSNKYYADSVKG

SEQ ID NO: 1392 - protein, 18 aa, Artificial Sequence
  No.232 HC CDR3
GDYYGSGSYYNPSPFFDY

SEQ ID NO: 1393 - protein, 13 aa, Artificial Sequence
  No.233 LC CDR1
SGSSSNIGSNTVN

SEQ ID NO: 1394 - protein, 7 aa, Artificial Sequence
  No.233 LC CDR2
SNNQRPS

SEQ ID NO: 1395 - protein, 11 aa, Artificial Sequence
  No.233 LC CDR3
AAWDDSLNGYV

SEQ ID NO: 1396 - protein, 5 aa, Artificial Sequence
  No.233 HC CDR1
RFAMH

SEQ ID NO: 1397 - protein, 17 aa, Artificial Sequence
  No.233 HC CDR2
VVSYDGSNNYYADSVKG

SEQ ID NO: 1398 - protein, 18 aa, Artificial Sequence
  No.233 HC CDR3
GDYYGSGSYYNPSPFFDY

SEQ ID NO: 1399 - protein, 13 aa, Artificial Sequence
  No.234 LC CDR1
SGSSSNIGSNTVN

SEQ ID NO: 1400 - protein, 7 aa, Artificial Sequence
  No.234 LC CDR2
SNNQRPS

SEQ ID NO: 1401 - protein, 11 aa, Artificial Sequence
  No.234 LC CDR3
AAWDDSLNGYV

SEQ ID NO: 1402 - protein, 5 aa, Artificial Sequence
  No.234 HC CDR1
RFAMH

SEQ ID NO: 1403 - protein, 17 aa, Artificial Sequence
  No.234 HC CDR2
VVSYDGSNNYYADSVKG

SEQ ID NO: 1404 - protein, 18 aa, Artificial Sequence
  No.234 HC CDR3
GDYYGSGSYYNPSPFFDY

SEQ ID NO: 1405 - protein, 13 aa, Artificial Sequence
  No.235 LC CDR1
SGSSSNIGSNTVN

SEQ ID NO: 1406 - protein, 7 aa, Artificial Sequence
  No.235 LC CDR2
SNNQRPS

SEQ ID NO: 1407 - protein, 11 aa, Artificial Sequence
  No.235 LC CDR3
AAWDDSLNGYV

SEQ ID NO: 1408 - protein, 5 aa, Artificial Sequence
  No.235 HC CDR1
SYAMH

SEQ ID NO: 1409 - protein, 17 aa, Artificial Sequence
  No.235 HC CDR2
VISFDGSNKYYADSVKG

SEQ ID NO: 1410 - protein, 18 aa, Artificial Sequence
  No.235 HC CDR3
GDYYGSGSYYNPSPFFDY

SEQ ID NO: 1411 - protein, 13 aa, Artificial Sequence
  No.236 LC CDR1
SGSSSNIGSNTVN

SEQ ID NO: 1412 - protein, 7 aa, Artificial Sequence
  No.236 LC CDR2
SNNQRPS

SEQ ID NO: 1413 - protein, 11 aa, Artificial Sequence
  No.236 LC CDR3
GTWDSNSETWV

SEQ ID NO: 1414 - protein, 5 aa, Artificial Sequence
  No.236 HC CDR1
TYSMH

SEQ ID NO: 1415 - protein, 17 aa, Artificial Sequence
  No.236 HC CDR2
VISYDGSNKYYADSVKG

SEQ ID NO: 1416 - protein, 18 aa, Artificial Sequence
  No.236 HC CDR3
GDYYGSGSYYNPSPFFDY

SEQ ID NO: 1417 - protein, 13 aa, Artificial Sequence
  No.237 LC CDR1
SGSNSNIGSNTVN

SEQ ID NO: 1418 - protein, 7 aa, Artificial Sequence
  No.237 LC CDR2
SNNQRPS

SEQ ID NO: 1419 - protein, 11 aa, Artificial Sequence
  No.237 LC CDR3
AAWDDSLNGYV

SEQ ID NO: 1420 - protein, 5 aa, Artificial Sequence
  No.237 HC CDR1
SFAMH

SEQ ID NO: 1421 - protein, 17 aa, Artificial Sequence
  No.237 HC CDR2
VISYDGSNKYYADSVKG

SEQ ID NO: 1422 - protein, 18 aa, Artificial Sequence
  No.237 HC CDR3
GDYYGSGSYYNPSPFFDY

SEQ ID NO: 1423 - protein, 13 aa, Artificial Sequence
  No.238 LC CDR1
SGSSSNIGSNTVN

SEQ ID NO: 1424 - protein, 7 aa, Artificial Sequence
  No.238 LC CDR2
SNNQRPS

SEQ ID NO: 1425 - protein, 11 aa, Artificial Sequence
  No.238 LC CDR3
AAWDDSLNGWV

SEQ ID NO: 1426 - protein, 5 aa, Artificial Sequence
  No.238 HC CDR1
TYSMH

SEQ ID NO: 1427 - protein, 17 aa, Artificial Sequence
  No.238 HC CDR2
VISYDGSNKYYADSVKG

SEQ ID NO: 1428 - protein, 18 aa, Artificial Sequence
  No.238 HC CDR3
GDYYGSGSYYNPSPFFDY

SEQ ID NO: 1429 - protein, 13 aa, Artificial Sequence
  No.239 LC CDR1
SGSSSNIGSKTVN

SEQ ID NO: 1430 - protein, 7 aa, Artificial Sequence
  No.239 LC CDR2
SNNQRPS

SEQ ID NO: 1431 - protein, 11 aa, Artificial Sequence
  No.239 LC CDR3
AAWDDSLSGWV

SEQ ID NO: 1432 - protein, 5 aa, Artificial Sequence
  No.239 HC CDR1
NFAMH

SEQ ID NO: 1433 - protein, 17 aa, Artificial Sequence
  No.239 HC CDR2
VISYDGSNKYYADSVKG

SEQ ID NO: 1434 - protein, 18 aa, Artificial Sequence
  No.239 HC CDR3
GDYYGSGSYYNPSPFFDY

SEQ ID NO: 1435 - protein, 13 aa, Artificial Sequence
  No.240 LC CDR1
SGSSSNIGSNTVN

SEQ ID NO: 1436 - protein, 7 aa, Artificial Sequence
  No.240 LC CDR2
SNNQRPS

SEQ ID NO: 1437 - protein, 11 aa, Artificial Sequence
  No.240 LC CDR3
AAWDDSLSGWV

SEQ ID NO: 1438 - protein, 5 aa, Artificial Sequence
  No.240 HC CDR1
NFAMH

SEQ ID NO: 1439 - protein, 17 aa, Artificial Sequence
  No.240 HC CDR2
VISYDGSNKYYADSVKG

SEQ ID NO: 1440 - protein, 18 aa, Artificial Sequence
  No.240 HC CDR3
GDYYGSGSYYNPSPFFDY

SEQ ID NO: 1441 - protein, 13 aa, Artificial Sequence
  No.241 LC CDR1
SGSSSNIGINSVN

SEQ ID NO: 1442 - protein, 7 aa, Artificial Sequence
  No.241 LC CDR2
SNNQRPS

SEQ ID NO: 1443 - protein, 11 aa, Artificial Sequence
  No.241 LC CDR3
AAWDDSLNGYV

SEQ ID NO: 1444 - protein, 5 aa, Artificial Sequence
  No.241 HC CDR1
SFAMH

SEQ ID NO: 1445 - protein, 17 aa, Artificial Sequence
  No.241 HC CDR2
VISYDGSNKYYADSVKG

SEQ ID NO: 1446 - protein, 18 aa, Artificial Sequence
  No.241 HC CDR3
GDYYGSGSYYNPSPFFDY

SEQ ID NO: 1447 - protein, 13 aa, Artificial Sequence
  No.242 LC CDR1
SGSSSNIGSKTVN

SEQ ID NO: 1448 - protein, 7 aa, Artificial Sequence
  No.242 LC CDR2
SNNQRPS

SEQ ID NO: 1449 - protein, 11 aa, Artificial Sequence
  No.242 LC CDR3
ATWDDSLNGWV

SEQ ID NO: 1450 - protein, 5 aa, Artificial Sequence
  No.242 HC CDR1
SFAMH

SEQ ID NO: 1451 - protein, 17 aa, Artificial Sequence
  No.242 HC CDR2
VISYDGSNKYYAESVKG

SEQ ID NO: 1452 - protein, 18 aa, Artificial Sequence
  No.242 HC CDR3
GDYYGSGSYYNPSPFFDY

SEQ ID NO: 1453 - protein, 13 aa, Artificial Sequence
  No.243 LC CDR1
SGSSSNIGSNTVN

SEQ ID NO: 1454 - protein, 7 aa, Artificial Sequence
  No.243 LC CDR2
SNNQRPS

SEQ ID NO: 1455 - protein, 11 aa, Artificial Sequence
  No.243 LC CDR3
AAWDDSLSGWV

SEQ ID NO: 1456 - protein, 5 aa, Artificial Sequence
  No.243 HC CDR1
SFAMH

SEQ ID NO: 1457 - protein, 17 aa, Artificial Sequence
  No.243 HC CDR2
VISYDGSNKYYADSVKG

SEQ ID NO: 1458 - protein, 18 aa, Artificial Sequence
  No.243 HC CDR3
GDYYGSGSYYNPSPFFDY

SEQ ID NO: 1459 - protein, 13 aa, Artificial Sequence
  No.244 LC CDR1
SGSSSNIGSNTVN

SEQ ID NO: 1460 - protein, 7 aa, Artificial Sequence
  No.244 LC CDR2
SNNQRPS

SEQ ID NO: 1461 - protein, 11 aa, Artificial Sequence
  No.244 LC CDR3
AAWDDSLNGYV

SEQ ID NO: 1462 - protein, 5 aa, Artificial Sequence
  No.244 HC CDR1
NFAMH

SEQ ID NO: 1463 - protein, 17 aa, Artificial Sequence
  No.244 HC CDR2
VISYDGSNKYYADSVKG

SEQ ID NO: 1464 - protein, 18 aa, Artificial Sequence
  No.244 HC CDR3
GDYYGSGSYYNPSPFFDY

SEQ ID NO: 1465 - protein, 13 aa, Artificial Sequence
  No.245 LC CDR1
SGSSSNIGSNTVN

SEQ ID NO: 1466 - protein, 7 aa, Artificial Sequence
  No.245 LC CDR2
SNNQRPS

SEQ ID NO: 1467 - protein, 11 aa, Artificial Sequence
  No.245 LC CDR3
ATWDDSLNAWV

SEQ ID NO: 1468 - protein, 5 aa, Artificial Sequence
  No.245 HC CDR1
RFAMH

SEQ ID NO: 1469 - protein, 17 aa, Artificial Sequence
  No.245 HC CDR2
VVSYDGSNNYYADSVKG

SEQ ID NO: 1470 - protein, 18 aa, Artificial Sequence
  No.245 HC CDR3
GDYYGSGSYYNPSPFFDY

SEQ ID NO: 1471 - protein, 13 aa, Artificial Sequence
  No.246 LC CDR1
SGSSSNIGSNTVN

SEQ ID NO: 1472 - protein, 7 aa, Artificial Sequence
  No.246 LC CDR2
SNNQRPS

SEQ ID NO: 1473 - protein, 11 aa, Artificial Sequence
  No.246 LC CDR3
ATWDDSLNGYV

SEQ ID NO: 1474 - protein, 5 aa, Artificial Sequence
  No.246 HC CDR1
RFAMH

SEQ ID NO: 1475 - protein, 17 aa, Artificial Sequence
  No.246 HC CDR2
VVSYDGSNNYYADSVKG

SEQ ID NO: 1476 - protein, 18 aa, Artificial Sequence
  No.246 HC CDR3
GDYYGSGSYYNPSPFFDY

SEQ ID NO: 1477 - protein, 13 aa, Artificial Sequence
  No.247 LC CDR1
SGSSSNIGSNTVN

SEQ ID NO: 1478 - protein, 6 aa, Artificial Sequence
  No.247 LC CDR2
SNQRPS

SEQ ID NO: 1479 - protein, 11 aa, Artificial Sequence
  No.247 LC CDR3
AAWDDSLSGWV

SEQ ID NO: 1480 - protein, 5 aa, Artificial Sequence
  No.247 HC CDR1
RFAMH

SEQ ID NO: 1481 - protein, 17 aa, Artificial Sequence
  No.247 HC CDR2
VVSYDGSNNYYADSVKG

SEQ ID NO: 1482 - protein, 18 aa, Artificial Sequence
  No.247 HC CDR3
GDYYGSGSYYNPSPFFDY

SEQ ID NO: 1483 - protein, 13 aa, Artificial Sequence
  No.248 LC CDR1
SGSSSNIGNNYVS

SEQ ID NO: 1484 - protein, 7 aa, Artificial Sequence
  No.248 LC CDR2
DNNKRPS

SEQ ID NO: 1485 - protein, 11 aa, Artificial Sequence
  No.248 LC CDR3
GTWDSSLSAVV

SEQ ID NO: 1486 - protein, 7 aa, Artificial Sequence
  No.248 HC CDR1
TSGVGVG

SEQ ID NO: 1487 - protein, 16 aa, Artificial Sequence
  No.248 HC CDR2
LIDWDDNKYYTTSLKT

SEQ ID NO: 1488 - protein, 18 aa, Artificial Sequence
  No.248 HC CDR3
IPGFLRYRNRYYYYGMDV

SEQ ID NO: 1489 - protein, 11 aa, Artificial Sequence
  No.249 LC CDR1
GGNNIGSKSVH

SEQ ID NO: 1490 - protein, 7 aa, Artificial Sequence
  No.249 LC CDR2
YDSDRPS

SEQ ID NO: 1491 - protein, 11 aa, Artificial Sequence
  No.249 LC CDR3
QVWDGSSDHYV

SEQ ID NO: 1492 - protein, 5 aa, Artificial Sequence
  No.249 HC CDR1
SYAMS

SEQ ID NO: 1493 - protein, 17 aa, Artificial Sequence
  No.249 HC CDR2
AISGSGGSTYYADSVKG

SEQ ID NO: 1494 - protein, 14 aa, Artificial Sequence
  No.249 HC CDR3
LSHGVVGAQDAFDI

SEQ ID NO: 1495 - protein, 14 aa, Artificial Sequence
  No.250 LC CDR1
TGSSSNIGAGYDVH

SEQ ID NO: 1496 - protein, 7 aa, Artificial Sequence
  No.250 LC CDR2
GNSNRPS

SEQ ID NO: 1497 - protein, 11 aa, Artificial Sequence
  No.250 LC CDR3
QSYDSSLSGSV

SEQ ID NO: 1498 - protein, 5 aa, Artificial Sequence
  No.250 HC CDR1
SYAIS

SEQ ID NO: 1499 - protein, 17 aa, Artificial Sequence
  No.250 HC CDR2
RIIPILGIANYAQKFQG

SEQ ID NO: 1500 - protein, 14 aa, Artificial Sequence
  No.250 HC CDR3
EEATTGINTNWFDP

SEQ ID NO: 1501 - protein, 13 aa, Artificial Sequence
  No.251 LC CDR1
SGSSSNIGSNTVN

SEQ ID NO: 1502 - protein, 7 aa, Artificial Sequence
  No.251 LC CDR2
SNNQRPS

SEQ ID NO: 1503 - protein, 11 aa, Artificial Sequence
  No.251 LC CDR3
AAWDDSLNGVV

SEQ ID NO: 1504 - protein, 5 aa, Artificial Sequence
  No.251 HC CDR1
DYAMH

SEQ ID NO: 1505 - protein, 17 aa, Artificial Sequence
  No.251 HC CDR2
GIDWNSGLIGYADAVKG

SEQ ID NO: 1506 - protein, 13 aa, Artificial Sequence
  No.251 HC CDR3
DMGSTGGYYGMDV

SEQ ID NO: 1507 - protein, 13 aa, Artificial Sequence
  No.252 LC CDR1
SGSSSNIGSNTVN

SEQ ID NO: 1508 - protein, 7 aa, Artificial Sequence
  No.252 LC CDR2
SNNQRPS

SEQ ID NO: 1509 - protein, 11 aa, Artificial Sequence
  No.252 LC CDR3
AAWDDSLNGPV

SEQ ID NO: 1510 - protein, 5 aa, Artificial Sequence
  No.252 HC CDR1
DYAMH

SEQ ID NO: 1511 - protein, 17 aa, Artificial Sequence
  No.252 HC CDR2
GIDWNSGLIGYADAVKG

SEQ ID NO: 1512 - protein, 13 aa, Artificial Sequence
  No.252 HC CDR3
DMGSTGGYYGMDV

SEQ ID NO: 1513 - protein, 13 aa, Artificial Sequence
  No.253 LC CDR1
SGSSSNIGSNTVN

SEQ ID NO: 1514 - protein, 7 aa, Artificial Sequence
  No.253 LC CDR2
SNNQRPS

SEQ ID NO: 1515 - protein, 11 aa, Artificial Sequence
  No.253 LC CDR3
AAWDDSLNGVV

SEQ ID NO: 1516 - protein, 5 aa, Artificial Sequence
  No.253 HC CDR1
DYAMH

SEQ ID NO: 1517 - protein, 17 aa, Artificial Sequence
  No.253 HC CDR2
GIDWNSGLIGYADAVKG

SEQ ID NO: 1518 - protein, 13 aa, Artificial Sequence
  No.253 HC CDR3
DMGSTGGYYGMDV

SEQ ID NO: 1519 - protein, 11 aa, Artificial Sequence
  No.254 LC CDR1
GGNNIGSKSVH

SEQ ID NO: 1520 - protein, 7 aa, Artificial Sequence
  No.254 LC CDR2
YDSDRPS

SEQ ID NO: 1521 - protein, 11 aa, Artificial Sequence
  No.254 LC CDR3
QVWDSSSDHPV

SEQ ID NO: 1522 - protein, 5 aa, Artificial Sequence
  No.254 HC CDR1
DYAMH

SEQ ID NO: 1523 - protein, 17 aa, Artificial Sequence
  No.254 HC CDR2
GIDWNSGLIGYADAVKG

SEQ ID NO: 1524 - protein, 13 aa, Artificial Sequence
  No.254 HC CDR3
DMGSTGGYYGMDV

SEQ ID NO: 1525 - protein, 13 aa, Artificial Sequence
  No.255 LC CDR1
TRSSGSIASNYVQ

SEQ ID NO: 1526 - protein, 7 aa, Artificial Sequence
  No.255 LC CDR2
EDNQRPS

SEQ ID NO: 1527 - protein, 10 aa, Artificial Sequence
  No.255 LC CDR3
QSYDSSNHAV

SEQ ID NO: 1528 - protein, 5 aa, Artificial Sequence
  No.255 HC CDR1
DYAMH

SEQ ID NO: 1529 - protein, 17 aa, Artificial Sequence
  No.255 HC CDR2
GIDWNSGLIGYADAVKG

SEQ ID NO: 1530 - protein, 13 aa, Artificial Sequence
  No.255 HC CDR3
DMGSTGGYYGMDV

SEQ ID NO: 1531 - protein, 13 aa, Artificial Sequence
  No.256 LC CDR1
SGSSSNIGNNYVS

SEQ ID NO: 1532 - protein, 7 aa, Artificial Sequence
  No.256 LC CDR2
DNNKRPS

SEQ ID NO: 1533 - protein, 11 aa, Artificial Sequence
  No.256 LC CDR3
GTWDSSLSAGV

SEQ ID NO: 1534 - protein, 5 aa, Artificial Sequence
  No.256 HC CDR1
DYAMH

SEQ ID NO: 1535 - protein, 17 aa, Artificial Sequence
  No.256 HC CDR2
GIDWNSGLIGYADAVKG

SEQ ID NO: 1536 - protein, 13 aa, Artificial Sequence
  No.256 HC CDR3
DMGSTGGYYGMDV

SEQ ID NO: 1537 - protein, 13 aa, Artificial Sequence
  No.257 LC CDR1
SGSSSNIGSNTVN

SEQ ID NO: 1538 - protein, 7 aa, Artificial Sequence
  No.257 LC CDR2
SNNQRPS

SEQ ID NO: 1539 - protein, 11 aa, Artificial Sequence
  No.257 LC CDR3
AAWDDSLNGVV

SEQ ID NO: 1540 - protein, 5 aa, Artificial Sequence
  No.257 HC CDR1
DYAMH

SEQ ID NO: 1541 - protein, 17 aa, Artificial Sequence
  No.257 HC CDR2
GIDWNSGLIGYADAVKG

SEQ ID NO: 1542 - protein, 13 aa, Artificial Sequence
  No.257 HC CDR3
DMGSTGGYYGMDV

SEQ ID NO: 1543 - protein, 13 aa, Artificial Sequence
  No.258 LC CDR1
SGSSSNIGNNYVS

SEQ ID NO: 1544 - protein, 7 aa, Artificial Sequence
  No.258 LC CDR2
DNNKRPS

SEQ ID NO: 1545 - protein, 11 aa, Artificial Sequence
  No.258 LC CDR3
GTWDSSLSAVV

SEQ ID NO: 1546 - protein, 5 aa, Artificial Sequence
  No.258 HC CDR1
DYAMH

SEQ ID NO: 1547 - protein, 17 aa, Artificial Sequence
  No.258 HC CDR2
GIDWNSGLIGYADAVKG

SEQ ID NO: 1548 - protein, 13 aa, Artificial Sequence
  No.258 HC CDR3
DMGSTGGYYGMDV

SEQ ID NO: 1549 - protein, 13 aa, Artificial Sequence
  No.259 LC CDR1
SGSSSNIGSNTVN

SEQ ID NO: 1550 - protein, 7 aa, Artificial Sequence
  No.259 LC CDR2
SNNQRPS

SEQ ID NO: 1551 - protein, 11 aa, Artificial Sequence
  No.259 LC CDR3
AAWDDSLNGVV

SEQ ID NO: 1552 - protein, 5 aa, Artificial Sequence
  No.259 HC CDR1
DYAMH

SEQ ID NO: 1553 - protein, 17 aa, Artificial Sequence
  No.259 HC CDR2
GIDWNSGLIGYADAVKG

SEQ ID NO: 1554 - protein, 13 aa, Artificial Sequence
  No.259 HC CDR3
DMGSTGGYYGMDV

SEQ ID NO: 1555 - protein, 13 aa, Artificial Sequence
  No.260 LC CDR1
SGSSSNIGSNTVN

SEQ ID NO: 1556 - protein, 7 aa, Artificial Sequence
  No.260 LC CDR2
TNNQRPS

SEQ ID NO: 1557 - protein, 11 aa, Artificial Sequence
  No.260 LC CDR3
AAWDDSLNGLV

SEQ ID NO: 1558 - protein, 5 aa, Artificial Sequence
  No.260 HC CDR1
DYAMH

SEQ ID NO: 1559 - protein, 17 aa, Artificial Sequence
  No.260 HC CDR2
GIDWNSGLIGYADAVKG

SEQ ID NO: 1560 - protein, 13 aa, Artificial Sequence
  No.260 HC CDR3
DMGSTGGYYGMDV

SEQ ID NO: 1561 - protein, 13 aa, Artificial Sequence
  No.261 LC CDR1
SGSSSNIGNNYVS

SEQ ID NO: 1562 - protein, 7 aa, Artificial Sequence
  No.261 LC CDR2
DNDKRPS

SEQ ID NO: 1563 - protein, 11 aa, Artificial Sequence
  No.261 LC CDR3
GTWDSSLSAYV

SEQ ID NO: 1564 - protein, 5 aa, Artificial Sequence
  No.261 HC CDR1
DYAMH

SEQ ID NO: 1565 - protein, 17 aa, Artificial Sequence
  No.261 HC CDR2
GIDWNSGLIGYADAVKG

SEQ ID NO: 1566 - protein, 13 aa, Artificial Sequence
  No.261 HC CDR3
DMGSTGGYYGMDV

SEQ ID NO: 1567 - protein, 13 aa, Artificial Sequence
  No.262 LC CDR1
SGSSSNIGSNTVN

SEQ ID NO: 1568 - protein, 7 aa, Artificial Sequence
  No.262 LC CDR2
SNNQRPS

SEQ ID NO: 1569 - protein, 11 aa, Artificial Sequence
  No.262 LC CDR3
QSYDSSLSGYV

SEQ ID NO: 1570 - protein, 5 aa, Artificial Sequence
  No.262 HC CDR1
DYAMH

SEQ ID NO: 1571 - protein, 17 aa, Artificial Sequence
  No.262 HC CDR2
GIDWNSGLIGYADAVKG

SEQ ID NO: 1572 - protein, 13 aa, Artificial Sequence
  No.262 HC CDR3
DMGSTGGYYGMDV

SEQ ID NO: 1573 - protein, 13 aa, Artificial Sequence
  No.263 LC CDR1
SGSSPNIGNNYVS

SEQ ID NO: 1574 - protein, 7 aa, Artificial Sequence
  No.263 LC CDR2
DNNKRPS

SEQ ID NO: 1575 - protein, 11 aa, Artificial Sequence
  No.263 LC CDR3
GTWDSSLSAYV

SEQ ID NO: 1576 - protein, 5 aa, Artificial Sequence
  No.263 HC CDR1
DYAMH

SEQ ID NO: 1577 - protein, 17 aa, Artificial Sequence
  No.263 HC CDR2
GIDWNSGLIGYADAVKG

SEQ ID NO: 1578 - protein, 13 aa, Artificial Sequence
  No.263 HC CDR3
DMGSTGGYYGMDV

SEQ ID NO: 1579 - protein, 13 aa, Artificial Sequence
  No.264 LC CDR1
SGSSSNIGNNYVS

SEQ ID NO: 1580 - protein, 7 aa, Artificial Sequence
  No.264 LC CDR2
DNNKRPS

SEQ ID NO: 1581 - protein, 11 aa, Artificial Sequence
  No.264 LC CDR3
GTWDSSLSAYV

SEQ ID NO: 1582 - protein, 5 aa, Artificial Sequence
  No.264 HC CDR1
DYAMH

SEQ ID NO: 1583 - protein, 17 aa, Artificial Sequence
  No.264 HC CDR2
GIDWNSGLIGYADAVKG

SEQ ID NO: 1584 - protein, 13 aa, Artificial Sequence
  No.264 HC CDR3
DMGSTGGYYGMDV

SEQ ID NO: 1585 - protein, 14 aa, Artificial Sequence
  No.265 LC CDR1
TGSSSNIGAGYDVH

SEQ ID NO: 1586 - protein, 7 aa, Artificial Sequence
  No.265 LC CDR2
GNSNRPS

SEQ ID NO: 1587 - protein, 10 aa, Artificial Sequence
  No.265 LC CDR3
QSYDSSLSGV

SEQ ID NO: 1588 - protein, 5 aa, Artificial Sequence
  No.265 HC CDR1
SNYMT

SEQ ID NO: 1589 - protein, 16 aa, Artificial Sequence
  No.265 HC CDR2
VIYSGGSTFYADSVKG

SEQ ID NO: 1590 - protein, 9 aa, Artificial Sequence
  No.265 HC CDR3
DLVVYGMDV

SEQ ID NO: 1591 - protein, 11 aa, Artificial Sequence
  No.266 LC CDR1
GGNNIGSKSVH

SEQ ID NO: 1592 - protein, 7 aa, Artificial Sequence
  No.266 LC CDR2
YDSDRPS

SEQ ID NO: 1593 - protein, 11 aa, Artificial Sequence
  No.266 LC CDR3
QVRDSSSDHPV

SEQ ID NO: 1594 - protein, 5 aa, Artificial Sequence
  No.266 HC CDR1
SNYMT

SEQ ID NO: 1595 - protein, 16 aa, Artificial Sequence
  No.266 HC CDR2
VIYSGGSTFYADSVKG

SEQ ID NO: 1596 - protein, 9 aa, Artificial Sequence
  No.266 HC CDR3
DLVVYGMDV

SEQ ID NO: 1597 - protein, 14 aa, Artificial Sequence
  No.267 LC CDR1
TGSSSNIGAGYDVH

SEQ ID NO: 1598 - protein, 7 aa, Artificial Sequence
  No.267 LC CDR2
GNSNRPS

SEQ ID NO: 1599 - protein, 10 aa, Artificial Sequence
  No.267 LC CDR3
QSYDSSLSGV

SEQ ID NO: 1600 - protein, 5 aa, Artificial Sequence
  No.267 HC CDR1
SNYMT

SEQ ID NO: 1601 - protein, 16 aa, Artificial Sequence
  No.267 HC CDR2
VIYSGGSTFYADSVKG

SEQ ID NO: 1602 - protein, 9 aa, Artificial Sequence
  No.267 HC CDR3
DLVVYGMDV

SEQ ID NO: 1603 - protein, 14 aa, Artificial Sequence
  No.268 LC CDR1
TGSDSNIGAGYDVH

SEQ ID NO: 1604 - protein, 7 aa, Artificial Sequence
  No.268 LC CDR2
NNNNRPS

SEQ ID NO: 1605 - protein, 11 aa, Artificial Sequence
  No.268 LC CDR3
QSSDSGLTGWV

SEQ ID NO: 1606 - protein, 5 aa, Artificial Sequence
  No.268 HC CDR1
SNYMT

SEQ ID NO: 1607 - protein, 16 aa, Artificial Sequence
  No.268 HC CDR2
VIYSGGSTFYADSVKG

SEQ ID NO: 1608 - protein, 9 aa, Artificial Sequence
  No.268 HC CDR3
DLVVYGMDV

SEQ ID NO: 1609 - protein, 14 aa, Artificial Sequence
  No.269 LC CDR1
TGSSSNIGAGYDVH

SEQ ID NO: 1610 - protein, 7 aa, Artificial Sequence
  No.269 LC CDR2
GNSNRPS

SEQ ID NO: 1611 - protein, 11 aa, Artificial Sequence
  No.269 LC CDR3
QSYDSSLSGSV

SEQ ID NO: 1612 - protein, 5 aa, Artificial Sequence
  No.269 HC CDR1
SNYMT

SEQ ID NO: 1613 - protein, 16 aa, Artificial Sequence
  No.269 HC CDR2
VIYSGGSTFYADSVKG

SEQ ID NO: 1614 - protein, 9 aa, Artificial Sequence
  No.269 HC CDR3
DLVVYGMDV

SEQ ID NO: 1615 - protein, 11 aa, Artificial Sequence
  No.270 LC CDR1
RASQSVSSYLA

SEQ ID NO: 1616 - protein, 7 aa, Artificial Sequence
  No.270 LC CDR2
DASNRAT

SEQ ID NO: 1617 - protein, 9 aa, Artificial Sequence
  No.270 LC CDR3
QQYGSSPLT

SEQ ID NO: 1618 - protein, 5 aa, Artificial Sequence
  No.270 HC CDR1
SNYMT

SEQ ID NO: 1619 - protein, 16 aa, Artificial Sequence
  No.270 HC CDR2
VIYSGGSTFYADSVKG

SEQ ID NO: 1620 - protein, 9 aa, Artificial Sequence
  No.270 HC CDR3
DLVVYGMDV

SEQ ID NO: 1621 - protein, 13 aa, Artificial Sequence
  No.271 LC CDR1
SGSSSNIGSNTVN

SEQ ID NO: 1622 - protein, 7 aa, Artificial Sequence
  No.271 LC CDR2
SNNQRPS

SEQ ID NO: 1623 - protein, 10 aa, Artificial Sequence
  No.271 LC CDR3
SSYAGSNNLV

SEQ ID NO: 1624 - protein, 5 aa, Artificial Sequence
  No.271 HC CDR1
SNYMT

SEQ ID NO: 1625 - protein, 16 aa, Artificial Sequence
  No.271 HC CDR2
VIYSGGSTFYADSVKG

SEQ ID NO: 1626 - protein, 9 aa, Artificial Sequence
  No.271 HC CDR3
DLVVYGMDV

SEQ ID NO: 1627 - protein, 14 aa, Artificial Sequence
  No.272 LC CDR1
TGSSSNIGAGYDVH

SEQ ID NO: 1628 - protein, 7 aa, Artificial Sequence
  No.272 LC CDR2
GNSNRPS

SEQ ID NO: 1629 - protein, 11 aa, Artificial Sequence
  No.272 LC CDR3
QSYDSSLSGSV

SEQ ID NO: 1630 - protein, 5 aa, Artificial Sequence
  No.272 HC CDR1
SNYMT

SEQ ID NO: 1631 - protein, 16 aa, Artificial Sequence
  No.272 HC CDR2
VIYSGGSTFYADSVKG

SEQ ID NO: 1632 - protein, 9 aa, Artificial Sequence
  No.272 HC CDR3
DLVVYGMDV

SEQ ID NO: 1633 - protein, 11 aa, Artificial Sequence
  No.273 LC CDR1
RASQSVSSYLA

SEQ ID NO: 1634 - protein, 7 aa, Artificial Sequence
  No.273 LC CDR2
DASNRAT

SEQ ID NO: 1635 - protein, 9 aa, Artificial Sequence
  No.273 LC CDR3
QQYGSSPLT

SEQ ID NO: 1636 - protein, 5 aa, Artificial Sequence
  No.273 HC CDR1
SNYMT

SEQ ID NO: 1637 - protein, 16 aa, Artificial Sequence
  No.273 HC CDR2
VIYSGGSTFYADSVKG

SEQ ID NO: 1638 - protein, 9 aa, Artificial Sequence
  No.273 HC CDR3
DLVVYGMDV

SEQ ID NO: 1639 - protein, 14 aa, Artificial Sequence
  No.274 LC CDR1
TGSSSNIGAGYDVH

SEQ ID NO: 1640 - protein, 7 aa, Artificial Sequence
  No.274 LC CDR2
GNSNRPS

SEQ ID NO: 1641 - protein, 10 aa, Artificial Sequence
  No.274 LC CDR3
QSYDSSLGVV

SEQ ID NO: 1642 - protein, 5 aa, Artificial Sequence
  No.274 HC CDR1
SNYMT

SEQ ID NO: 1643 - protein, 16 aa, Artificial Sequence
  No.274 HC CDR2
VIYSGGSTFYADSVKG

SEQ ID NO: 1644 - protein, 9 aa, Artificial Sequence
  No.274 HC CDR3
DLVVYGMDV

SEQ ID NO: 1645 - protein, 11 aa, Artificial Sequence
  No.275 LC CDR1
GGNNIGSNTVN

SEQ ID NO: 1646 - protein, 7 aa, Artificial Sequence
  No.275 LC CDR2
SNNLRPS

SEQ ID NO: 1647 - protein, 11 aa, Artificial Sequence
  No.275 LC CDR3
AAWDDSLNGPV

SEQ ID NO: 1648 - protein, 5 aa, Artificial Sequence
  No.275 HC CDR1
SNYMT

SEQ ID NO: 1649 - protein, 16 aa, Artificial Sequence
  No.275 HC CDR2
VIYSGGSTFYADSVKG

SEQ ID NO: 1650 - protein, 9 aa, Artificial Sequence
  No.275 HC CDR3
DLVVYGMDV

SEQ ID NO: 1651 - protein, 13 aa, Artificial Sequence
  No.276 LC CDR1
SGSSSNIGGSDVG

SEQ ID NO: 1652 - protein, 7 aa, Artificial Sequence
  No.276 LC CDR2
KSNQRPS

SEQ ID NO: 1653 - protein, 10 aa, Artificial Sequence
  No.276 LC CDR3
ATWDDRLNWV

SEQ ID NO: 1654 - protein, 5 aa, Artificial Sequence
  No.276 HC CDR1
SNYMT

SEQ ID NO: 1655 - protein, 16 aa, Artificial Sequence
  No.276 HC CDR2
VIYSGGSTFYADSVKG

SEQ ID NO: 1656 - protein, 9 aa, Artificial Sequence
  No.276 HC CDR3
DLVVYGMDV

SEQ ID NO: 1657 - protein, 11 aa, Artificial Sequence
  No.277 LC CDR1
RASQSISSYLN

SEQ ID NO: 1658 - protein, 7 aa, Artificial Sequence
  No.277 LC CDR2
AASSLQS

SEQ ID NO: 1659 - protein, 9 aa, Artificial Sequence
  No.277 LC CDR3
QQSYSTPFT

SEQ ID NO: 1660 - protein, 5 aa, Artificial Sequence
  No.277 HC CDR1
NYYMH

SEQ ID NO: 1661 - protein, 17 aa, Artificial Sequence
  No.277 HC CDR2
IINPSGGSTSYAQKFQG

SEQ ID NO: 1662 - protein, 13 aa, Artificial Sequence
  No.277 HC CDR3
GGIAPYTRGAFDY

SEQ ID NO: 1663 - protein, 11 aa, Artificial Sequence
  No.278 LC CDR1
QAGQDISNYLN

SEQ ID NO: 1664 - protein, 7 aa, Artificial Sequence
  No.278 LC CDR2
KASSLES

SEQ ID NO: 1665 - protein, 9 aa, Artificial Sequence
  No.278 LC CDR3
QQAHSFPFT

SEQ ID NO: 1666 - protein, 5 aa, Artificial Sequence
  No.278 HC CDR1
SYYMH

SEQ ID NO: 1667 - protein, 17 aa, Artificial Sequence
  No.278 HC CDR2
IINPSGGSTSYAQKFQG

SEQ ID NO: 1668 - protein, 13 aa, Artificial Sequence
  No.278 HC CDR3
GGIAPYTRGAFDY

SEQ ID NO: 1669 - protein, 11 aa, Artificial Sequence
  No.279 LC CDR1
QASQDISNYLN

SEQ ID NO: 1670 - protein, 7 aa, Artificial Sequence
  No.279 LC CDR2
DASNLET

SEQ ID NO: 1671 - protein, 9 aa, Artificial Sequence
  No.279 LC CDR3
QQSYSTLPT

SEQ ID NO: 1672 - protein, 5 aa, Artificial Sequence
  No.279 HC CDR1
SYYMH

SEQ ID NO: 1673 - protein, 17 aa, Artificial Sequence
  No.279 HC CDR2
IINPSGGSTSYAQKFQG

SEQ ID NO: 1674 - protein, 13 aa, Artificial Sequence
  No.279 HC CDR3
GGIAPYTRGAFDY

SEQ ID NO: 1675 - protein, 14 aa, Artificial Sequence
  No.280 LC CDR1
TGSSSNTGAGYDVH

SEQ ID NO: 1676 - protein, 7 aa, Artificial Sequence
  No.280 LC CDR2
SNNQRPS

SEQ ID NO: 1677 - protein, 11 aa, Artificial Sequence
  No.280 LC CDR3
AAWDDSLNGGV

SEQ ID NO: 1678 - protein, 5 aa, Artificial Sequence
  No.280 HC CDR1
SNYMS

SEQ ID NO: 1679 - protein, 16 aa, Artificial Sequence
  No.280 HC CDR2
VIYSGGSTNYADSVKG

SEQ ID NO: 1680 - protein, 9 aa, Artificial Sequence
  No.280 HC CDR3
DLIVYGMDV

SEQ ID NO: 1681 - protein, 14 aa, Artificial Sequence
  No.281 LC CDR1
TGSSSNIGAGYDVH

SEQ ID NO: 1682 - protein, 7 aa, Artificial Sequence
  No.281 LC CDR2
GNSNRPS

SEQ ID NO: 1683 - protein, 11 aa, Artificial Sequence
  No.281 LC CDR3
AAWDDSLSGWV

SEQ ID NO: 1684 - protein, 5 aa, Artificial Sequence
  No.281 HC CDR1
SNYMS

SEQ ID NO: 1685 - protein, 16 aa, Artificial Sequence
  No.281 HC CDR2
VIYSGGSTNYADSVKG

SEQ ID NO: 1686 - protein, 9 aa, Artificial Sequence
  No.281 HC CDR3
DLIVYGMDV

SEQ ID NO: 1687 - protein, 14 aa, Artificial Sequence
  No.282 LC CDR1
SGSSSNIGAGYDVH

SEQ ID NO: 1688 - protein, 7 aa, Artificial Sequence
  No.282 LC CDR2
GNSNRPS

SEQ ID NO: 1689 - protein, 11 aa, Artificial Sequence
  No.282 LC CDR3
AAWDDSLNGGV

SEQ ID NO: 1690 - protein, 5 aa, Artificial Sequence
  No.282 HC CDR1
SNYMS

SEQ ID NO: 1691 - protein, 16 aa, Artificial Sequence
  No.282 HC CDR2
VIYSGGSTNYADSVKG

SEQ ID NO: 1692 - protein, 9 aa, Artificial Sequence
  No.282 HC CDR3
DLIVYGMDV

SEQ ID NO: 1693 - protein, 11 aa, Artificial Sequence
  No.283 LC CDR1
RASQSVSSYLA

SEQ ID NO: 1694 - protein, 7 aa, Artificial Sequence
  No.283 LC CDR2
DASNRAT

SEQ ID NO: 1695 - protein, 10 aa, Artificial Sequence
  No.283 LC CDR3
QQYGSSPPYT

SEQ ID NO: 1696 - protein, 5 aa, Artificial Sequence
  No.283 HC CDR1
SNYMS

SEQ ID NO: 1697 - protein, 16 aa, Artificial Sequence
  No.283 HC CDR2
VIYPGGSTYYADSVKG

SEQ ID NO: 1698 - protein, 8 aa, Artificial Sequence
  No.283 HC CDR3
DLRGVLDY

SEQ ID NO: 1699 - protein, 13 aa, Artificial Sequence
  No.284 LC CDR1
SGSSSNIGNNYVS

SEQ ID NO: 1700 - protein, 7 aa, Artificial Sequence
  No.284 LC CDR2
DNNKRPS

SEQ ID NO: 1701 - protein, 11 aa, Artificial Sequence
  No.284 LC CDR3
GTWDSSLSAGV

SEQ ID NO: 1702 - protein, 5 aa, Artificial Sequence
  No.284 HC CDR1
SNYMS

SEQ ID NO: 1703 - protein, 16 aa, Artificial Sequence
  No.284 HC CDR2
VIYSGGSTYYADSVKG

SEQ ID NO: 1704 - protein, 11 aa, Artificial Sequence
  No.284 HC CDR3
GHVDIPYGMDV

SEQ ID NO: 1705 - protein, 14 aa, Artificial Sequence
  No.285 LC CDR1
TGSSSNIGAGYDVH

SEQ ID NO: 1706 - protein, 7 aa, Artificial Sequence
  No.285 LC CDR2
GNSNRPS

SEQ ID NO: 1707 - protein, 11 aa, Artificial Sequence
  No.285 LC CDR3
QSYDSSLSGSV

SEQ ID NO: 1708 - protein, 5 aa, Artificial Sequence
  No.285 HC CDR1
SYAIS

SEQ ID NO: 1709 - protein, 17 aa, Artificial Sequence
  No.285 HC CDR2
RIIPILGIANYAQKFQG

SEQ ID NO: 1710 - protein, 15 aa, Artificial Sequence
  No.285 HC CDR3
EKGYSGSGSVNWFDP

SEQ ID NO: 1711 - protein, 14 aa, Artificial Sequence
  No.286 LC CDR1
TGSSSNIGAGYDVH

SEQ ID NO: 1712 - protein, 7 aa, Artificial Sequence
  No.286 LC CDR2
GNSNRPS

SEQ ID NO: 1713 - protein, 11 aa, Artificial Sequence
  No.286 LC CDR3
QSYDSSLSGSV

SEQ ID NO: 1714 - protein, 5 aa, Artificial Sequence
  No.286 HC CDR1
SYAIS

SEQ ID NO: 1715 - protein, 17 aa, Artificial Sequence
  No.286 HC CDR2
RIIPILGIANYAQKFQG

SEQ ID NO: 1716 - protein, 15 aa, Artificial Sequence
  No.286 HC CDR3
EKGYSGSGSVNWFDP

SEQ ID NO: 1717 - protein, 14 aa, Artificial Sequence
  No.287 LC CDR1
TGSSSNIGAGYDVH

SEQ ID NO: 1718 - protein, 7 aa, Artificial Sequence
  No.287 LC CDR2
GNSNRPS

SEQ ID NO: 1719 - protein, 11 aa, Artificial Sequence
  No.287 LC CDR3
QSYDSSLSGSV

SEQ ID NO: 1720 - protein, 5 aa, Artificial Sequence
  No.287 HC CDR1
SYAIS

SEQ ID NO: 1721 - protein, 17 aa, Artificial Sequence
  No.287 HC CDR2
RIIPILGIANYAQKFQG

SEQ ID NO: 1722 - protein, 14 aa, Artificial Sequence
  No.287 HC CDR3
EEATTGINTNWFDP

SEQ ID NO: 1723 - protein, 13 aa, Artificial Sequence
  No.288 LC CDR1
TRSSGSIASNYVQ

SEQ ID NO: 1724 - protein, 7 aa, Artificial Sequence
  No.288 LC CDR2
EDNQRPS

SEQ ID NO: 1725 - protein, 10 aa, Artificial Sequence
  No.288 LC CDR3
QSYDSSNHWV

SEQ ID NO: 1726 - protein, 5 aa, Artificial Sequence
  No.288 HC CDR1
SYAMH

SEQ ID NO: 1727 - protein, 17 aa, Artificial Sequence
  No.288 HC CDR2
VISYDGSNKYYADSVKG

SEQ ID NO: 1728 - protein, 16 aa, Artificial Sequence
  No.288 HC CDR3
ANLGYCTNGVCAPSGG

SEQ ID NO: 1729 - protein, 13 aa, Artificial Sequence
  No.289 LC CDR1
SGGSSNIGNNYVS

SEQ ID NO: 1730 - protein, 7 aa, Artificial Sequence
  No.289 LC CDR2
DNNKRPS

SEQ ID NO: 1731 - protein, 11 aa, Artificial Sequence
  No.289 LC CDR3
GTWDSSLSAWV

SEQ ID NO: 1732 - protein, 5 aa, Artificial Sequence
  No.289 HC CDR1
DYAMH

SEQ ID NO: 1733 - protein, 17 aa, Artificial Sequence
  No.289 HC CDR2
GISWNSGRIGYADSVKG

SEQ ID NO: 1734 - protein, 16 aa, Artificial Sequence
  No.289 HC CDR3
NLRYFDWLLGDDAFDI

SEQ ID NO: 1735 - protein, 14 aa, Artificial Sequence
  No.290 LC CDR1
TGSSSNIGAGYDVH

SEQ ID NO: 1736 - protein, 7 aa, Artificial Sequence
  No.290 LC CDR2
GNSNRPS

SEQ ID NO: 1737 - protein, 11 aa, Artificial Sequence
  No.290 LC CDR3
QSYDSSLSGSV

SEQ ID NO: 1738 - protein, 5 aa, Artificial Sequence
  No.290 HC CDR1
SNYMT

SEQ ID NO: 1739 - protein, 16 aa, Artificial Sequence
  No.290 HC CDR2
VIYSGGSTFYADSVKG

SEQ ID NO: 1740 - protein, 9 aa, Artificial Sequence
  No.290 HC CDR3
DLVVYGMDV

SEQ ID NO: 1741 - protein, 107 aa, Artificial Sequence
  No.1  LC variable region
ELQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIK

SEQ ID NO: 1742 - protein, 128 aa, Artificial Sequence
  No.1  HC variable region
EVQLLESGGGLVQPGRSLRLSCAASGFTFGDYAMHWVRQAPGKGLEWVSGISWNSGRIGYADSVKGRFTISRDNAKNSLYLQMNSLRAEDTALYYCAKGDCGGDCYSFLLGEDAFDIWGQGTMVTVSS

SEQ ID NO: 1743 - protein, 107 aa, Artificial Sequence
  No.2  LC variable region
ELQMTQSPSSLSASVGDRVTITCRASQSISTYLNWYQQKVGKAPKLLIYAASSLQSGVPSRFSGRGSGTDFTLTISSLQPEDFATYYCQQSYSIPHTFGQGTKLEIK

SEQ ID NO: 1744 - protein, 128 aa, Artificial Sequence; identical to SEQ ID NO: 1742
  No.2  HC variable region

SEQ ID NO: 1745 - protein, 107 aa, Artificial Sequence
  No.3  LC variable region
ELVMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK

SEQ ID NO: 1746 - protein, 128 aa, Artificial Sequence
  No.3  HC variable region
EVQLVESGGGVVQPGRSLRLSCAASGFTFSSYAMSWVRQAPGKGLEWVSAISGSGGSTYYADSVKGRFTISRDNSKNTLYLQMNSLRAEDTAVYYCAKSLVSGRYCSGVTCYSWFDPWGQGTLVTVSS

SEQ ID NO: 1747 - protein, 107 aa, Artificial Sequence
  No.4  LC variable region
ELVMTQSPSSLSASVGDRVTITCQASQDISNYLNWYQQKPGKAPKLLIYDASNLETGVPSRFSGSGSGTDFTFTISSLQPEDIATYYCQQYDDLPITFGQGTRLEIK

SEQ ID NO: 1748 - protein, 128 aa, Artificial Sequence
  No.4  HC variable region
EVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKSLVSGRYCSGVTCYSWFDPWGQGTLVTVSS

SEQ ID NO: 1749 - protein, 107 aa, Artificial Sequence; identical to SEQ ID NO: 1745
  No.5  LC variable region

SEQ ID NO: 1750 - protein, 128 aa, Artificial Sequence; identical to SEQ ID NO: 1746
  No.5  HC variable region

SEQ ID NO: 1751 - protein, 110 aa, Artificial Sequence
  No.6  LC variable region
ELELTQPPSVSGTPGQRVTISCSGSSSNIGSNYVYWYQQLPGTAPKLLIYRNNQRPSGVPDRFSGSKSGTSASLAISGLRSEDEADYYCAAWDDSLSGKVFGGGTKVTVL

SEQ ID NO: 1752 - protein, 131 aa, Artificial Sequence
  No.6  HC variable region
EVQLVQSGAEVKKPGSSVKVSCKASGGTFSSYAISWVRQAPGQGLEWMGGIIPIFGTANYAQKFQDRVTITADESTSTAYMELSSLRSEDTAVYYCARDGVVVPAVMYDTTDPYYYGMDVWGQGTTVTVSS

SEQ ID NO: 1753 - protein, 110 aa, Artificial Sequence
  No.7  LC variable region
ELELTQPPSVSGTPGQRVTISCSGSSSNIGSNYVYWYQQLPGTAPKLLIYRNNQRPPGVPDRFSGSKSGTSASLAISGLRSEDEADYYCAAWDDSLSGRVFGGGTELTVL

SEQ ID NO: 1754 - protein, 131 aa, Artificial Sequence
  No.7  HC variable region
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDGVVVPAVMYDTTDPYYYGMDVWGQGTTVTVSS

SEQ ID NO: 1755 - protein, 110 aa, Artificial Sequence
  No.8  LC variable region
ELELTQPPSVSGTPGQRVTISCSGSSSNIGSNYVYWYQQLPGTAPKLLIYRNNQRPSGVPDRFSGSKSGTSASLAISGLRSEDEADYYCAAWDDSLSGRVFGGGTKVTVL

SEQ ID NO: 1756 - protein, 131 aa, Artificial Sequence
  No.8  HC variable region
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDGVVVPAVMYDTTDPYYYGMDVWGQGTTVTVSS

SEQ ID NO: 1757 - protein, 110 aa, Artificial Sequence
  No.9  LC variable region
ELELTQPPSASGTPGQRVTISCSGSSSNIGSNYVYWYQQLPGTAPKLLIYRNNQRPSGVPDRFSGSKSGTSASLAISGLRSEDEADYYCAAWDDSLNGRVFGGGTKVTVL

SEQ ID NO: 1758 - protein, 131 aa, Artificial Sequence; identical to SEQ ID NO: 1754
  No.9  HC variable region

SEQ ID NO: 1759 - protein, 110 aa, Artificial Sequence
  No.10  LC variable region
ELVLTQSPSASGTPGQRVTISCSGSSSNIGSNYVYWYQQLPGTAPKLLIYRNNQRPSGVPDRFSGSKSGTSASLAISGLRSEDEADYYCAAWDDSLSGRVFGGGTKVTVL

SEQ ID NO: 1760 - protein, 131 aa, Artificial Sequence
  No.10  HC variable region
EVQLVQSGAEVKKPGSSVKVSCKASGGTFSSYAISWVRQAPGQGLEWMGGIIPIFGTENYAQKFQGRVTITADESTSTAYMELSSLRSEDTAVYYCARDGVVVPAVMYDTTDPYYYGMDVWGQGTTVTVSS

SEQ ID NO: 1761 - protein, 110 aa, Artificial Sequence; identical to SEQ ID NO: 1759
  No.11  LC variable region

SEQ ID NO: 1762 - protein, 131 aa, Artificial Sequence; identical to SEQ ID NO: 1760
  No.11  HC variable region

SEQ ID NO: 1763 - protein, 110 aa, Artificial Sequence; identical to SEQ ID NO: 1751
  No.12  LC variable region

SEQ ID NO: 1764 - protein, 131 aa, Artificial Sequence; identical to SEQ ID NO: 1752
  No.12  HC variable region

SEQ ID NO: 1765 - protein, 110 aa, Artificial Sequence
  No.13  LC variable region
ELVLTQPPSASGTPGQSVTISCSGSSSNIGNNYVYWYQQLPGTAPKLLIYGNYQRPSGVPDRFSGSKSGTSASLAISGLRSEDEADYYCAAWDDSLSGRVFGGGTKLTVL

SEQ ID NO: 1766 - protein, 131 aa, Artificial Sequence; identical to SEQ ID NO: 1756
  No.13  HC variable region

SEQ ID NO: 1767 - protein, 110 aa, Artificial Sequence
  No.14  LC variable region
ELELTQPPSVSGAPGQRVTISCSGSSSNIGGNYVHWYQQLPGAAPKLLIYSNDQRPSGVPDRFSGSKSGTSASLAISGLQSEDEADYYCAAWDDSLNGRVFGGGTQLTVL

SEQ ID NO: 1768 - protein, 131 aa, Artificial Sequence; identical to SEQ ID NO: 1756
  No.14  HC variable region

SEQ ID NO: 1769 - protein, 110 aa, Artificial Sequence; identical to SEQ ID NO: 1753
  No.15  LC variable region

SEQ ID NO: 1770 - protein, 131 aa, Artificial Sequence; identical to SEQ ID NO: 1754
  No.15  HC variable region

SEQ ID NO: 1771 - protein, 110 aa, Artificial Sequence; identical to SEQ ID NO: 1751
  No.16  LC variable region

SEQ ID NO: 1772 - protein, 131 aa, Artificial Sequence; identical to SEQ ID NO: 1752
  No.16  HC variable region

SEQ ID NO: 1773 - protein, 110 aa, Artificial Sequence; identical to SEQ ID NO: 1751
  No.17  LC variable region

SEQ ID NO: 1774 - protein, 131 aa, Artificial Sequence; identical to SEQ ID NO: 1752
  No.17  HC variable region

SEQ ID NO: 1775 - protein, 111 aa, Artificial Sequence
  No.18  LC variable region
ELVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGKVFGGGTKVTVL

SEQ ID NO: 1776 - protein, 131 aa, Artificial Sequence
  No.18  HC variable region
QVQLVQSGAEVKKPGASVKVSCKASGGTFSSYAISWVRQAPGQGLEWMGGIIPIFGTANYAQKFQGRVTITADESTSTAYMELSSLRSEDTAVYYCARDGVVVPAVMYDTTDPYYYGMDVWGQGTTVTVSS

SEQ ID NO: 1777 - protein, 110 aa, Artificial Sequence
  No.19  LC variable region
ELELTQPPSVSGTPGQRVTISCSGSSSNIGSNYVYWYQQLPGTAPKLLIYRNNQRPSGVPDRFSGSKSGTSASLAISGLRSEDEADYYCAAWDDSLSGRVFGGGTKLTVL

SEQ ID NO: 1778 - protein, 131 aa, Artificial Sequence; identical to SEQ ID NO: 1756
  No.19  HC variable region

SEQ ID NO: 1779 - protein, 110 aa, Artificial Sequence; identical to SEQ ID NO: 1751
  No.20  LC variable region

SEQ ID NO: 1780 - protein, 131 aa, Artificial Sequence; identical to SEQ ID NO: 1752
  No.20  HC variable region

SEQ ID NO: 1781 - protein, 110 aa, Artificial Sequence; identical to SEQ ID NO: 1751
  No.21  LC variable region

SEQ ID NO: 1782 - protein, 131 aa, Artificial Sequence; identical to SEQ ID NO: 1752
  No.21  HC variable region

SEQ ID NO: 1783 - protein, 110 aa, Artificial Sequence; identical to SEQ ID NO: 1751
  No.22  LC variable region

SEQ ID NO: 1784 - protein, 131 aa, Artificial Sequence; identical to SEQ ID NO: 1752
  No.22  HC variable region

SEQ ID NO: 1785 - protein, 110 aa, Artificial Sequence; identical to SEQ ID NO: 1751
  No.23  LC variable region

SEQ ID NO: 1786 - protein, 131 aa, Artificial Sequence; identical to SEQ ID NO: 1752
  No.23  HC variable region

SEQ ID NO: 1787 - protein, 110 aa, Artificial Sequence; identical to SEQ ID NO: 1753
  No.24  LC variable region

SEQ ID NO: 1788 - protein, 131 aa, Artificial Sequence; identical to SEQ ID NO: 1754
  No.24  HC variable region

SEQ ID NO: 1789 - protein, 110 aa, Artificial Sequence; identical to SEQ ID NO: 1751
  No.25  LC variable region

SEQ ID NO: 1790 - protein, 131 aa, Artificial Sequence; identical to SEQ ID NO: 1752
  No.25  HC variable region

SEQ ID NO: 1791 - protein, 110 aa, Artificial Sequence; identical to SEQ ID NO: 1751
  No.26  LC variable region

SEQ ID NO: 1792 - protein, 131 aa, Artificial Sequence; identical to SEQ ID NO: 1752
  No.26  HC variable region

SEQ ID NO: 1793 - protein, 110 aa, Artificial Sequence; identical to SEQ ID NO: 1751
  No.27  LC variable region

SEQ ID NO: 1794 - protein, 131 aa, Artificial Sequence; identical to SEQ ID NO: 1752
  No.27  HC variable region

SEQ ID NO: 1795 - protein, 110 aa, Artificial Sequence; identical to SEQ ID NO: 1757
  No.28  LC variable region

SEQ ID NO: 1796 - protein, 131 aa, Artificial Sequence; identical to SEQ ID NO: 1754
  No.28  HC variable region

SEQ ID NO: 1797 - protein, 110 aa, Artificial Sequence; identical to SEQ ID NO: 1751
  No.29  LC variable region

SEQ ID NO: 1798 - protein, 131 aa, Artificial Sequence; identical to SEQ ID NO: 1752
  No.29  HC variable region

SEQ ID NO: 1799 - protein, 110 aa, Artificial Sequence; identical to SEQ ID NO: 1751
  No.30  LC variable region

SEQ ID NO: 1800 - protein, 131 aa, Artificial Sequence; identical to SEQ ID NO: 1752
  No.30  HC variable region

SEQ ID NO: 1801 - protein, 110 aa, Artificial Sequence
  No.31  LC variable region
ELGLTQPPSVSGTPGQRVTISCSGSSSNIGGNYVHWYQQLPGAAPKLLIYSNDQRPSGVPDRFSGSKSGTSASLAISGLQSEDEADYYCAAWDDSLSGRVFGGGTKLTVL

SEQ ID NO: 1802 - protein, 131 aa, Artificial Sequence
  No.31  HC variable region
QVQLVQSGAEVKKPGSSVKVSCKASGGTFSSYAISWVRRAPGQGLEWMGGIIPIFGTANYAQKFQGRVTITADESTSTAYMELSSLRSEDTAVYYCARDGVVVPAVMYDTTDPYYYGMDVWGQGTTVTVSS

SEQ ID NO: 1803 - protein, 110 aa, Artificial Sequence; identical to SEQ ID NO: 1751
  No.32  LC variable region

SEQ ID NO: 1804 - protein, 131 aa, Artificial Sequence; identical to SEQ ID NO: 1752
  No.32  HC variable region

SEQ ID NO: 1805 - protein, 110 aa, Artificial Sequence; identical to SEQ ID NO: 1751
  No.33  LC variable region

SEQ ID NO: 1806 - protein, 131 aa, Artificial Sequence; identical to SEQ ID NO: 1752
  No.33  HC variable region

SEQ ID NO: 1807 - protein, 110 aa, Artificial Sequence
  No.34  LC variable region
ELVLTQSPSASGTPGQRVTISCSGSSSNIGSNYVYWYQQLPGTAPKLLIYRNNQRPSGVPDRFSGSKSGTSASLAISGLRSEDEADYYCAAWDDSLSGRVFGGGTKLTVL

SEQ ID NO: 1808 - protein, 131 aa, Artificial Sequence
  No.34  HC variable region
QVQLVQSGAEVKKPGSSVKVSCKASGGTFSSYAISWVRQAPGQGLEWMGGIIPIFGTANYAQKFQGRVTITTDESTSTAYMELSSLRSEDTAVYYCARDGVVVPAVMYDTTDPYYYGMDVWGQGTTVTVSS

SEQ ID NO: 1809 - protein, 110 aa, Artificial Sequence; identical to SEQ ID NO: 1755
  No.35  LC variable region

SEQ ID NO: 1810 - protein, 131 aa, Artificial Sequence; identical to SEQ ID NO: 1756
  No.35  HC variable region

SEQ ID NO: 1811 - protein, 110 aa, Artificial Sequence
  No.36  LC variable region
ELVVTQPPSASGAPGQRVTISCSGGSSNIGSNYVYWYQQLPGTAPKLLIYRNNQRPSGVPDRFSGSKSGTSASLAISGLRSEDEADYYCAAWDDSLSGRVFGGGTKLTVL

SEQ ID NO: 1812 - protein, 131 aa, Artificial Sequence; identical to SEQ ID NO: 1754
  No.36  HC variable region

SEQ ID NO: 1813 - protein, 110 aa, Artificial Sequence; identical to SEQ ID NO: 1753
  No.37  LC variable region

SEQ ID NO: 1814 - protein, 131 aa, Artificial Sequence; identical to SEQ ID NO: 1754
  No.37  HC variable region

SEQ ID NO: 1815 - protein, 110 aa, Artificial Sequence; identical to SEQ ID NO: 1777
  No.38  LC variable region

SEQ ID NO: 1816 - protein, 131 aa, Artificial Sequence; identical to SEQ ID NO: 1756
  No.38  HC variable region

SEQ ID NO: 1817 - protein, 110 aa, Artificial Sequence; identical to SEQ ID NO: 1777
  No.39  LC variable region

SEQ ID NO: 1818 - protein, 131 aa, Artificial Sequence; identical to SEQ ID NO: 1754
  No.39  HC variable region

SEQ ID NO: 1819 - protein, 110 aa, Artificial Sequence; identical to SEQ ID NO: 1777
  No.40  LC variable region

SEQ ID NO: 1820 - protein, 131 aa, Artificial Sequence; identical to SEQ ID NO: 1754
  No.40  HC variable region

SEQ ID NO: 1821 - protein, 110 aa, Artificial Sequence; identical to SEQ ID NO: 1751
  No.41  LC variable region

SEQ ID NO: 1822 - protein, 131 aa, Artificial Sequence; identical to SEQ ID NO: 1752
  No.41  HC variable region

SEQ ID NO: 1823 - protein, 110 aa, Artificial Sequence; identical to SEQ ID NO: 1751
  No.42  LC variable region

SEQ ID NO: 1824 - protein, 131 aa, Artificial Sequence; identical to SEQ ID NO: 1752
  No.42  HC variable region

SEQ ID NO: 1825 - protein, 110 aa, Artificial Sequence; identical to SEQ ID NO: 1753
  No.43  LC variable region

SEQ ID NO: 1826 - protein, 131 aa, Artificial Sequence; identical to SEQ ID NO: 1754
  No.43  HC variable region

SEQ ID NO: 1827 - protein, 107 aa, Artificial Sequence
  No.44  LC variable region
ELVMTQSPATLSLSPGERATLSCRASQSVSSYLAWYQQKPGQAPRLLIYDASNRATGIPDRFSGSGSGTDFTLTISRLEPEDFAVYYCQQYVTTPYTFGQGTKVDIK

SEQ ID NO: 1828 - protein, 129 aa, Artificial Sequence
  No.44  HC variable region
QVQLQESGPGLVKPSETLSLTCTVSGGSISRSSYYWGWIRQPPGKGLEWIGNIYYSGSTYYNPSLKSRVTIPVDTSKNQFSLKLSSVTAADTAVYYCARGSRGYYDILTGYSTGGFDYWGQGTLVTVSS

SEQ ID NO: 1829 - protein, 107 aa, Artificial Sequence
  No.45  LC variable region
ELVMTQSPATLSVSPGERATLSCRASQSISSYLAWYQQKPGQAPRLLIYDASNRATGIPARFSGSGSGTEFTLTISRLEPEDFAVYYCQQYGSSPLTFGGGTKLEIK

SEQ ID NO: 1830 - protein, 129 aa, Artificial Sequence
  No.45  HC variable region
QVQLQESDPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS

SEQ ID NO: 1831 - protein, 108 aa, Artificial Sequence
  No.46  LC variable region
ELTLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 1832 - protein, 129 aa, Artificial Sequence
  No.46  HC variable region
EVQLVESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS

SEQ ID NO: 1833 - protein, 108 aa, Artificial Sequence
  No.47  LC variable region
ELVMTQSPGTLSLSPGERATLFCRASQSVSSSYLAWYQQKPGQAPRLLIYDASNRATGIPARFSGSGSGTDFTLTISSLEPEDFALYYCQQYGSSPLTFGGGTKLEIK

SEQ ID NO: 1834 - protein, 129 aa, Artificial Sequence
  No.47  HC variable region
QVQLQESGPGLVKPSETLSLTCTVSGDSISSSSYYWGWIRQPPGKGLEWIGNIFYSGSTYYNPSLKSRATISVDTSKNQFSLKLSSVTAADTAVYYCARGSRGYYDILTGYSTGGFDYWGQGTLVTVSS

SEQ ID NO: 1835 - protein, 108 aa, Artificial Sequence; identical to SEQ ID NO: 1831
  No.48  LC variable region

SEQ ID NO: 1836 - protein, 127 aa, Artificial Sequence
  No.48  HC variable region
QVQLQESGPGLVRPSETLSLTCSVSGGSISHYFWSWIRQSPGKGLEWIGNIYYSGSTYYNPSLKSRVTISVDTSKNQFSLKLSSVTAADTAVYYCARGSRGYYDILTGYSTGGFDYWGQGTLVTVSS

SEQ ID NO: 1837 - protein, 110 aa, Artificial Sequence
  No.49  LC variable region
ELALTQPPSVSGSPGQSITISCTGTSSDVGGYNYVSWYQQHPGKAPKLMIYDVSNRPSGVSNRFSGSKSGNTASLTISGLQAEDEADYYCSSYTSSSTVVFGGGTKVTVL

SEQ ID NO: 1838 - protein, 129 aa, Artificial Sequence
  No.49  HC variable region
QVQLQESGPGLVRPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS

SEQ ID NO: 1839 - protein, 107 aa, Artificial Sequence; identical to SEQ ID NO: 1829
  No.50  LC variable region

SEQ ID NO: 1840 - protein, 129 aa, Artificial Sequence; identical to SEQ ID NO: 1830
  No.50  HC variable region

SEQ ID NO: 1841 - protein, 107 aa, Artificial Sequence; identical to SEQ ID NO: 1829
  No.51  LC variable region

SEQ ID NO: 1842 - protein, 129 aa, Artificial Sequence; identical to SEQ ID NO: 1830
  No.51  HC variable region

SEQ ID NO: 1843 - protein, 108 aa, Artificial Sequence; identical to SEQ ID NO: 1833
  No.52  LC variable region

SEQ ID NO: 1844 - protein, 129 aa, Artificial Sequence; identical to SEQ ID NO: 1834
  No.52  HC variable region

SEQ ID NO: 1845 - protein, 107 aa, Artificial Sequence
  No.53  LC variable region
ELQMTQSPGTLSLSPGERATLSCRASQSISSYLAWYQQKPGQSPRLLIYGGSSRATGIPDRFSGSGSGTDFTLTISRLEPADFAVYYCQQYGSSPLTFGQGTRLEIK

SEQ ID NO: 1846 - protein, 129 aa, Artificial Sequence
  No.53  HC variable region
QVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS

SEQ ID NO: 1847 - protein, 110 aa, Artificial Sequence
  No.54  LC variable region
ELELTQPPSVSGSPGQSITISCTGTSSDVGGYNYVSWYQQHPGKAPKLMIYDVSNRPSGASNRFSGSKSGNTASLTISGLQAEDEADYYCSSYTSSSTHVFGTGTKVTVL

SEQ ID NO: 1848 - protein, 129 aa, Artificial Sequence
  No.54  HC variable region
RVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS

SEQ ID NO: 1849 - protein, 108 aa, Artificial Sequence
  No.55  LC variable region
ELVLTQSPATLSLSPGERATLSCRASQSVSTYLAWYQQKPGQAPRLLIYDASNRATGIPDRFSGSGSGTDFTLTISRLEPEDFAVYYCQQYGSSPSITFGQGTRLEIK

SEQ ID NO: 1850 - protein, 129 aa, Artificial Sequence
  No.55  HC variable region
QVQLQESGPGLVKPSETLSLTCTVSGGSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS

SEQ ID NO: 1851 - protein, 110 aa, Artificial Sequence
  No.56  LC variable region
ELTLTQSPGTLSLSPGERATLSCRASQSVSSSYLAWYQQKPGQAPRLLIYGASSRATGIPDRFSGSGSGTDFTLTISRLEPEDFAVYYCQEYGSSPGRVTFGPGTKVDIK

SEQ ID NO: 1852 - protein, 129 aa, Artificial Sequence; identical to SEQ ID NO: 1846
  No.56  HC variable region

SEQ ID NO: 1853 - protein, 108 aa, Artificial Sequence
  No.57  LC variable region
ELVMTQSPGILSLSPGERATLSCRASQSVSSSYLAWYQQKPGQAPRLLIYGASSRATGIPDRFSGSGSGTDFTLTISRLEPEDFAVYYCQQYGSSPLTFGGGTKVDIK

SEQ ID NO: 1854 - protein, 129 aa, Artificial Sequence; identical to SEQ ID NO: 1846
  No.57  HC variable region

SEQ ID NO: 1855 - protein, 108 aa, Artificial Sequence; identical to SEQ ID NO: 1831
  No.58  LC variable region

SEQ ID NO: 1856 - protein, 129 aa, Artificial Sequence; identical to SEQ ID NO: 1832
  No.58  HC variable region

SEQ ID NO: 1857 - protein, 108 aa, Artificial Sequence; identical to SEQ ID NO: 1831
  No.59  LC variable region

SEQ ID NO: 1858 - protein, 129 aa, Artificial Sequence; identical to SEQ ID NO: 1832
  No.59  HC variable region

SEQ ID NO: 1859 - protein, 108 aa, Artificial Sequence
  No.60  LC variable region
ELTLTQSPGTLSLPPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 1860 - protein, 129 aa, Artificial Sequence; identical to SEQ ID NO: 1846
  No.60  HC variable region

SEQ ID NO: 1861 - protein, 108 aa, Artificial Sequence
  No.61  LC variable region
ELVLTQSPGTLSLSPGERATLSCRASQSVSSYLAWYQQKPGQAPRLLIYDASNRATGIPARFSGSGSGTDFTLTISSLQAEDVAVYYCQQYYSTPSITFGQGTRLEIK

SEQ ID NO: 1862 - protein, 129 aa, Artificial Sequence; identical to SEQ ID NO: 1846
  No.61  HC variable region

SEQ ID NO: 1863 - protein, 108 aa, Artificial Sequence; identical to SEQ ID NO: 1833
  No.62  LC variable region

SEQ ID NO: 1864 - protein, 129 aa, Artificial Sequence; identical to SEQ ID NO: 1834
  No.62  HC variable region

SEQ ID NO: 1865 - protein, 110 aa, Artificial Sequence
  No.63  LC variable region
ELELTQPPSVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL

SEQ ID NO: 1866 - protein, 129 aa, Artificial Sequence
  No.63  HC variable region
QVQLQESGPGLVKPSETLSLTCTVSGDSISSSSYYWGWIRQPPGKGLEWIGNIFYSGSTYYNPSLKSRVTISVDTSKNQFSLKLSSVTAADTAVYYCVRGSRGYYDILTGYSTGGFDYWGQGTLVTVSS

SEQ ID NO: 1867 - protein, 108 aa, Artificial Sequence
  No.64  LC variable region
ELVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK

SEQ ID NO: 1868 - protein, 129 aa, Artificial Sequence; identical to SEQ ID NO: 1834
  No.64  HC variable region

SEQ ID NO: 1869 - protein, 110 aa, Artificial Sequence
  No.65  LC variable region
ELVMTQSPATLSLSPGESATLACRASQSVSSSFLAWYQQRPGQAPRLLIYGASSRATGIPDRFSGSGSGTDFTLTISRLEPEDFAVYYCQEYGSSPGRVTFGPGTKVDIK

SEQ ID NO: 1870 - protein, 129 aa, Artificial Sequence; identical to SEQ ID NO: 1846
  No.65  HC variable region

SEQ ID NO: 1871 - protein, 107 aa, Artificial Sequence
  No.66  LC variable region
ELVMTQSPGTLSLSPGERATLSCRASQSVSNYLAWYQQKPGQAPRLLIYDASNRATGIPARFSGSGSGTDFTLTISSLEPEDFAVYYCQQYGSSPLTFGGGTRLEIK

SEQ ID NO: 1872 - protein, 129 aa, Artificial Sequence; identical to SEQ ID NO: 1846
  No.66  HC variable region

SEQ ID NO: 1873 - protein, 107 aa, Artificial Sequence; identical to SEQ ID NO: 1871
  No.67  LC variable region

SEQ ID NO: 1874 - protein, 129 aa, Artificial Sequence; identical to SEQ ID NO: 1846
  No.67  HC variable region

SEQ ID NO: 1875 - protein, 110 aa, Artificial Sequence
  No.68  LC variable region
ELTLTQSPGTLSLSPGERATLPCRASQSVSSSYLAWYQQKPGQAPRLLIYGASSRATGIPDRFSGSGSGTDFTLTISRLEPEDFAVYYCQEYGSSPGRVTFGPGTKLEIK

SEQ ID NO: 1876 - protein, 129 aa, Artificial Sequence
  No.68  HC variable region
QVQLQESGPGLVKPSETLSLTCTVSGDSISSSSYYWGWIRQPPGKGLEWVGNIFYSGSTYYNPSLKSRVTISVDTSKNQFSLKLSSVTAADTAVYYCARGSRGYYDILTGYSTGGFDYWGQGTLVTVSS

SEQ ID NO: 1877 - protein, 109 aa, Artificial Sequence
  No.69  LC variable region
ELTLTQSPATLSVSPGERATLSCRASQSVRSSYLAWYQQKPGQAPRLLIHAASTRATGIPDRFSGSGSGTDFTLTISRVEPEDVAVYYCQQYGDSLSITFGQGTRLEIK

SEQ ID NO: 1878 - protein, 129 aa, Artificial Sequence; identical to SEQ ID NO: 1846
  No.69  HC variable region

SEQ ID NO: 1879 - protein, 108 aa, Artificial Sequence
  No.70  LC variable region
ELTLTQSPATLSVSPGERATLSCRASQSVSSYLAWYQQKPGQAPRLLIYDASNRATGIPARFSGSGSGTDFTLTISRLEPEDFAVYYCQQYGSSPSITFGQGTRLEIK

SEQ ID NO: 1880 - protein, 129 aa, Artificial Sequence; identical to SEQ ID NO: 1846
  No.70  HC variable region

SEQ ID NO: 1881 - protein, 107 aa, Artificial Sequence
  No.71  LC variable region
ELVLTQSPATLSVSPGEGATLSCRASQSVSSNLAWYQHKPGQAPRLLIYDASTRATGIPARFSGSGSGTEFTLTISSLQSEDFAVYYCQQYNNWPLTFGGGTKVDIK

SEQ ID NO: 1882 - protein, 129 aa, Artificial Sequence; identical to SEQ ID NO: 1846
  No.71  HC variable region

SEQ ID NO: 1883 - protein, 109 aa, Artificial Sequence
  No.72  LC variable region
ELELTQPPSVSGTPGQRVTISCSGSSSNIGSNYVSWYQQHPGKAPKLMIYDVSNRPSGVSNRFSGSKSGNTASLTISGLQAEDEADYYCSSYTSSSTLPFGTGTKVTVL

SEQ ID NO: 1884 - protein, 129 aa, Artificial Sequence; identical to SEQ ID NO: 1846
  No.72  HC variable region

SEQ ID NO: 1885 - protein, 110 aa, Artificial Sequence; identical to SEQ ID NO: 1869
  No.73  LC variable region

SEQ ID NO: 1886 - protein, 129 aa, Artificial Sequence
  No.73  HC variable region
QVQLQESGPGPVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS

SEQ ID NO: 1887 - protein, 107 aa, Artificial Sequence; identical to SEQ ID NO: 1871
  No.74  LC variable region

SEQ ID NO: 1888 - protein, 129 aa, Artificial Sequence; identical to SEQ ID NO: 1846
  No.74  HC variable region

SEQ ID NO: 1889 - protein, 108 aa, Artificial Sequence; identical to SEQ ID NO: 1831
  No.75  LC variable region

SEQ ID NO: 1890 - protein, 129 aa, Artificial Sequence; identical to SEQ ID NO: 1832
  No.75  HC variable region

SEQ ID NO: 1891 - protein, 108 aa, Artificial Sequence
  No.76  LC variable region
ELVMTQSPGTLSLSPGERATFFCRASQSVSSSYLAWYQQKPGQAPRLLIYDASNRATGIPARFSGSGSGTDFTLTISSLEPEDFALYYCQQYGSSPLTFGGGTKLEIK

SEQ ID NO: 1892 - protein, 129 aa, Artificial Sequence; identical to SEQ ID NO: 1834
  No.76  HC variable region

SEQ ID NO: 1893 - protein, 107 aa, Artificial Sequence; identical to SEQ ID NO: 1881
  No.77  LC variable region

SEQ ID NO: 1894 - protein, 129 aa, Artificial Sequence; identical to SEQ ID NO: 1846
  No.77  HC variable region

SEQ ID NO: 1895 - protein, 108 aa, Artificial Sequence; identical to SEQ ID NO: 1833
  No.78  LC variable region

SEQ ID NO: 1896 - protein, 129 aa, Artificial Sequence; identical to SEQ ID NO: 1834
  No.78  HC variable region

SEQ ID NO: 1897 - protein, 108 aa, Artificial Sequence; identical to SEQ ID NO: 1861
  No.79  LC variable region

SEQ ID NO: 1898 - protein, 129 aa, Artificial Sequence; identical to SEQ ID NO: 1846
  No.79  HC variable region

SEQ ID NO: 1899 - protein, 107 aa, Artificial Sequence; identical to SEQ ID NO: 1871
  No.80  LC variable region

SEQ ID NO: 1900 - protein, 129 aa, Artificial Sequence; identical to SEQ ID NO: 1846
  No.80  HC variable region

SEQ ID NO: 1901 - protein, 107 aa, Artificial Sequence
  No.81  LC variable region
ELTLTQSPATLSLSPGERATLSCRASQSVSSYLAWYQQKPGQAPRLLIYDASNRATGIPARFSGSGSGTDFTLTISSLEPEDFAVYYCQQYGSSPLTFGGGTKVEIK

SEQ ID NO: 1902 - protein, 129 aa, Artificial Sequence; identical to SEQ ID NO: 1846
  No.81  HC variable region

SEQ ID NO: 1903 - protein, 107 aa, Artificial Sequence; identical to SEQ ID NO: 1901
  No.82  LC variable region

SEQ ID NO: 1904 - protein, 129 aa, Artificial Sequence; identical to SEQ ID NO: 1846
  No.82  HC variable region

SEQ ID NO: 1905 - protein, 107 aa, Artificial Sequence
  No.83  LC variable region
ELQMTQSPATLSVSPGERATLSCRASQSVSSNLAWYQQKPGQAPRLLIYGASTRATGIPARFSGSGSGTEFTLTISSLQSEDFAVYYCQQYNNWPLTFGGGTKLEIK

SEQ ID NO: 1906 - protein, 129 aa, Artificial Sequence
  No.83  HC variable region
QVQLQESGPGLVKPSETLSLTCTVSGDSISGSSYYWGWIRQPPGKGLEWIGNIFYSGSTYYNPSLKSRVTISVDTSKNQFSLKLSSVTAADTAMYYCARGSRGYYDILTGYSTGGFDYWGQGTLVTVSS

SEQ ID NO: 1907 - protein, 110 aa, Artificial Sequence; identical to SEQ ID NO: 1865
  No.84  LC variable region

SEQ ID NO: 1908 - protein, 129 aa, Artificial Sequence; identical to SEQ ID NO: 1866
  No.84  HC variable region

SEQ ID NO: 1909 - protein, 107 aa, Artificial Sequence; identical to SEQ ID NO: 1829
  No.85  LC variable region

SEQ ID NO: 1910 - protein, 129 aa, Artificial Sequence; identical to SEQ ID NO: 1830
  No.85  HC variable region

SEQ ID NO: 1911 - protein, 107 aa, Artificial Sequence
  No.86  LC variable region
ELVLTQSPATLSLSPGERATLSCRASQSVSSYLAWYQQRAGQAPRLLIYDASSRATGIPDRFSGSGSGTDFTLTISRLEPEDFAVYYCQQYGSSPYTFGQGTKLEIK

SEQ ID NO: 1912 - protein, 129 aa, Artificial Sequence
  No.86  HC variable region
EVQLVQSGPGLVKPSETLSLTCTVSGDSISSSSYYWGWIRQPPGKGLEWIGNIFYSGSTYYNPSLKSRVTISVDTSKNQFSLKLSSVTAADTAVYYCARGSRGYYDILTGYSTGGFDYWGQGTLVTVSS

SEQ ID NO: 1913 - protein, 107 aa, Artificial Sequence; identical to SEQ ID NO: 1871
  No.87  LC variable region

SEQ ID NO: 1914 - protein, 129 aa, Artificial Sequence; identical to SEQ ID NO: 1846
  No.87  HC variable region

SEQ ID NO: 1915 - protein, 108 aa, Artificial Sequence
  No.88  LC variable region
ELVMTQSPGTLSLSPGERATLSCRASQSVSSYLAWYQQKPGQAPRLLIYDASNRATGIPDRFSGSGSGTDFTLTISRLEPEDFAVYYCQQYGSSPSITFGQGTRLEIK

SEQ ID NO: 1916 - protein, 129 aa, Artificial Sequence
  No.88  HC variable region
QVQLQESGPGLVKPSETLSLTCTVSGDSISSSSYYWGWIRQPPGKGLEWIGSIYYSGSTYYNPSLKSRVTISVDTSKNQFSLNLSSATAADTAVYYCARGSRGYYDFLTGYSTGGFDYWGQGTLVAVSS

SEQ ID NO: 1917 - protein, 110 aa, Artificial Sequence
  No.89  LC variable region
ELVLTQPPSVSAAPRQKVTISCSGSSSNIGDNYVSWYQQFPGTAPKLLIYDNDKRPSGIPDRFSGSKSGTSATLGITGLQTGDEADYYCGTWDSSLSAVVFGGGTQLTVL

SEQ ID NO: 1918 - protein, 128 aa, Artificial Sequence
  No.89  HC variable region
QITLKESGPTLVKPSQTLTLTCTFSGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS

SEQ ID NO: 1919 - protein, 110 aa, Artificial Sequence
  No.90  LC variable region
ELELTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTELTVL

SEQ ID NO: 1920 - protein, 128 aa, Artificial Sequence; identical to SEQ ID NO: 1918
  No.90  HC variable region

SEQ ID NO: 1921 - protein, 110 aa, Artificial Sequence
  No.91  LC variable region
ELVLTQPPSVSAAPGQKVTISCSGSSSNIGNNYVSWYQQLPGTAPKLLIYDNNKRPSGIPDRFSGSKSGTSATLGITGLQTGDEADYYCGTWDNSLSAGVFGTGTKVTVL

SEQ ID NO: 1922 - protein, 128 aa, Artificial Sequence
  No.91  HC variable region
QITLKESGPTLVKPAQTLRLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVFS

SEQ ID NO: 1923 - protein, 110 aa, Artificial Sequence
  No.92  LC variable region
ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL

SEQ ID NO: 1924 - protein, 128 aa, Artificial Sequence
  No.92  HC variable region
EVQLLESGPGLVKPSQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS

SEQ ID NO: 1925 - protein, 110 aa, Artificial Sequence
  No.93  LC variable region
ELELTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGRFGGGTKLTVL

SEQ ID NO: 1926 - protein, 128 aa, Artificial Sequence
  No.93  HC variable region
QITLKESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGVDVWGQGTTVTVSS

SEQ ID NO: 1927 - protein, 110 aa, Artificial Sequence; identical to SEQ ID NO: 1919
  No.94  LC variable region

SEQ ID NO: 1928 - protein, 128 aa, Artificial Sequence; identical to SEQ ID NO: 1918
  No.94  HC variable region

SEQ ID NO: 1929 - protein, 110 aa, Artificial Sequence
  No.95  LC variable region
ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTELTVL

SEQ ID NO: 1930 - protein, 128 aa, Artificial Sequence
  No.95  HC variable region
QITLKESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS

SEQ ID NO: 1931 - protein, 110 aa, Artificial Sequence; identical to SEQ ID NO: 1919
  No.96  LC variable region

SEQ ID NO: 1932 - protein, 128 aa, Artificial Sequence; identical to SEQ ID NO: 1918
  No.96  HC variable region

SEQ ID NO: 1933 - protein, 110 aa, Artificial Sequence; identical to SEQ ID NO: 1929
  No.97  LC variable region

SEQ ID NO: 1934 - protein, 128 aa, Artificial Sequence
  No.97  HC variable region
QITLKESGPTLVKPSQTLTLTCTFSGFSLTTSGMGVSWIRQPPGKALEWLALIDWDDNKYYTTSLKTRLTISKDTSKNQVVLTMTNMDPVDTATYYCARIPGFLRYRNRYYYYGMDVWGQGTTVTVSS

SEQ ID NO: 1935 - protein, 110 aa, Artificial Sequence
  No.98  LC variable region
ELVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL

SEQ ID NO: 1936 - protein, 128 aa, Artificial Sequence
  No.98  HC variable region
QITLKESGPTLVKPSQTLTLTCSFSGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS

SEQ ID NO: 1937 - protein, 110 aa, Artificial Sequence
  No.99  LC variable region
ELELTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKVTVL

SEQ ID NO: 1938 - protein, 128 aa, Artificial Sequence
  No.99  HC variable region
QITLKESGPTLVKPSQTLTLTCTFSGFSLTTSGMGVGWIRQPPGKALEWLGLIDWDDNKYYTTSLKTRLTISKDTSKNQVVLTMTNMDPVDTATYYCARIPGFLRYRNRYYYYGMDVWGQGTTVTVSS

SEQ ID NO: 1939 - protein, 110 aa, Artificial Sequence; identical to SEQ ID NO: 1935
  No.100  LC variable region

SEQ ID NO: 1940 - protein, 128 aa, Artificial Sequence
  No.100  HC variable region
QITLKESGPTLVKPSQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS

SEQ ID NO: 1941 - protein, 110 aa, Artificial Sequence; identical to SEQ ID NO: 1935
  No.101  LC variable region

SEQ ID NO: 1942 - protein, 128 aa, Artificial Sequence; identical to SEQ ID NO: 1940
  No.101  HC variable region

SEQ ID NO: 1943 - protein, 110 aa, Artificial Sequence
  No.102  LC variable region
ELVLTQPPSVSAAPGRKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL

SEQ ID NO: 1944 - protein, 128 aa, Artificial Sequence
  No.102  HC variable region
QITLKESGPTLVKPTQTLTLTCSFAGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS

SEQ ID NO: 1945 - protein, 110 aa, Artificial Sequence
  No.103  LC variable region
ELVLTQPPSVSAAPGQKVTISCSGSSSNIGKNYVSWYQQLPGTAPKLLIYDNNKRPSGIPDRFSGSKSGTSATLGITGLQTGDEADYYCGTWDSSLSAVVFGGGTKVTVL

SEQ ID NO: 1946 - protein, 128 aa, Artificial Sequence; identical to SEQ ID NO: 1930
  No.103  HC variable region

SEQ ID NO: 1947 - protein, 110 aa, Artificial Sequence
  No.104  LC variable region
ELVVTQPPSVSAAPGQKVTISCSGGSSNIGNNYVSWYQQLPGTAPKLLIYDNNKRPSGIPDRFSGSKSGTSATLGITGLQTGDEADYYCGTWDSSLSAGVFGGGTKVTVL

SEQ ID NO: 1948 - protein, 128 aa, Artificial Sequence
  No.104  HC variable region
QVQLQESGPTLVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS

SEQ ID NO: 1949 - protein, 110 aa, Artificial Sequence
  No.105  LC variable region
ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTQLTVL

SEQ ID NO: 1950 - protein, 128 aa, Artificial Sequence; identical to SEQ ID NO: 1930
  No.105  HC variable region

SEQ ID NO: 1951 - protein, 110 aa, Artificial Sequence; identical to SEQ ID NO: 1943
  No.106  LC variable region

SEQ ID NO: 1952 - protein, 128 aa, Artificial Sequence; identical to SEQ ID NO: 1944
  No.106  HC variable region

SEQ ID NO: 1953 - protein, 110 aa, Artificial Sequence; identical to SEQ ID NO: 1943
  No.107  LC variable region

SEQ ID NO: 1954 - protein, 128 aa, Artificial Sequence; identical to SEQ ID NO: 1944
  No.107  HC variable region

SEQ ID NO: 1955 - protein, 110 aa, Artificial Sequence
  No.108  LC variable region
ELELTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL

SEQ ID NO: 1956 - protein, 128 aa, Artificial Sequence
  No.108  HC variable region
QITLKESGPTLVKPTQTLTLTCTFSGFSLSTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS

SEQ ID NO: 1957 - protein, 110 aa, Artificial Sequence; identical to SEQ ID NO: 1955
  No.109  LC variable region

SEQ ID NO: 1958 - protein, 128 aa, Artificial Sequence; identical to SEQ ID NO: 1956
  No.109  HC variable region

SEQ ID NO: 1959 - protein, 110 aa, Artificial Sequence; identical to SEQ ID NO: 1919
  No.110  LC variable region

SEQ ID NO: 1960 - protein, 128 aa, Artificial Sequence; identical to SEQ ID NO: 1918
  No.110  HC variable region

SEQ ID NO: 1961 - protein, 110 aa, Artificial Sequence; identical to SEQ ID NO: 1935
  No.111  LC variable region

SEQ ID NO: 1962 - protein, 128 aa, Artificial Sequence; identical to SEQ ID NO: 1940
  No.111  HC variable region

SEQ ID NO: 1963 - protein, 110 aa, Artificial Sequence
  No.112  LC variable region
ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKVTVL

SEQ ID NO: 1964 - protein, 128 aa, Artificial Sequence; identical to SEQ ID NO: 1930
  No.112  HC variable region

SEQ ID NO: 1965 - protein, 110 aa, Artificial Sequence
  No.113  LC variable region
ELVLTQPPSVSAAPGQKVTISCSGSNSNIGNNYISWYQQFPGTAPKLLIYDNNKRPSGIPDRFSGSKSGTSATLGITGLQTGDEADYYCGTWDSSLSAGVFGGGTKVTVL

SEQ ID NO: 1966 - protein, 128 aa, Artificial Sequence
  No.113  HC variable region
QITLKESGPALVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGQGTTVTVSS

SEQ ID NO: 1967 - protein, 110 aa, Artificial Sequence; identical to SEQ ID NO: 1943
  No.114  LC variable region

SEQ ID NO: 1968 - protein, 128 aa, Artificial Sequence; identical to SEQ ID NO: 1944
  No.114  HC variable region

SEQ ID NO: 1969 - protein, 110 aa, Artificial Sequence; identical to SEQ ID NO: 1935
  No.115  LC variable region

SEQ ID NO: 1970 - protein, 128 aa, Artificial Sequence; identical to SEQ ID NO: 1940
  No.115  HC variable region

SEQ ID NO: 1971 - protein, 110 aa, Artificial Sequence; identical to SEQ ID NO: 1943
  No.116  LC variable region

SEQ ID NO: 1972 - protein, 128 aa, Artificial Sequence; identical to SEQ ID NO: 1944
  No.116  HC variable region

SEQ ID NO: 1973 - protein, 110 aa, Artificial Sequence; identical to SEQ ID NO: 1955
  No.117  LC variable region

SEQ ID NO: 1974 - protein, 128 aa, Artificial Sequence; identical to SEQ ID NO: 1956
  No.117  HC variable region

SEQ ID NO: 1975 - protein, 110 aa, Artificial Sequence
  No.118  LC variable region
ELVVTQPPSVSAAPGQKVTISCSGSNSNIGNNYVSWYQQLPGTAPKLLIYDNNKRPSGIPDRFSGSKSGTSATLGITGLQTGDEADYYCGTWDNSLSAGVFGTGTKVTVL

SEQ ID NO: 1976 - protein, 128 aa, Artificial Sequence; identical to SEQ ID NO: 1918
  No.118  HC variable region

SEQ ID NO: 1977 - protein, 110 aa, Artificial Sequence; identical to SEQ ID NO: 1955
  No.119  LC variable region

SEQ ID NO: 1978 - protein, 128 aa, Artificial Sequence; identical to SEQ ID NO: 1956
  No.119  HC variable region

SEQ ID NO: 1979 - protein, 110 aa, Artificial Sequence
  No.120  LC variable region
ELVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTELTVL

SEQ ID NO: 1980 - protein, 128 aa, Artificial Sequence
  No.120  HC variable region
QITLKESGPTLVKPTQTLTLTCTFSGFSLSTSGVGVGWIRQPPGKALEWLTLIDWDDNKYYTTSLKTRLTISKDTSKNQVVLTMTNMDPVDTATYYCARIPGFLRYRNRYYYYGMDVWGQGTTVTVSS

SEQ ID NO: 1981 - protein, 110 aa, Artificial Sequence; identical to SEQ ID NO: 1949
  No.121  LC variable region

SEQ ID NO: 1982 - protein, 128 aa, Artificial Sequence; identical to SEQ ID NO: 1940
  No.121  HC variable region

SEQ ID NO: 1983 - protein, 110 aa, Artificial Sequence; identical to SEQ ID NO: 1955
  No.122  LC variable region

SEQ ID NO: 1984 - protein, 128 aa, Artificial Sequence; identical to SEQ ID NO: 1956
  No.122  HC variable region

SEQ ID NO: 1985 - protein, 110 aa, Artificial Sequence; identical to SEQ ID NO: 1935
  No.123  LC variable region

SEQ ID NO: 1986 - protein, 128 aa, Artificial Sequence; identical to SEQ ID NO: 1940
  No.123  HC variable region

SEQ ID NO: 1987 - protein, 110 aa, Artificial Sequence; identical to SEQ ID NO: 1921
  No.124  LC variable region

SEQ ID NO: 1988 - protein, 128 aa, Artificial Sequence; identical to SEQ ID NO: 1922
  No.124  HC variable region

SEQ ID NO: 1989 - protein, 110 aa, Artificial Sequence; identical to SEQ ID NO: 1935
  No.125  LC variable region

SEQ ID NO: 1990 - protein, 128 aa, Artificial Sequence; identical to SEQ ID NO: 1940
  No.125  HC variable region

SEQ ID NO: 1991 - protein, 110 aa, Artificial Sequence; identical to SEQ ID NO: 1943
  No.126  LC variable region

SEQ ID NO: 1992 - protein, 128 aa, Artificial Sequence; identical to SEQ ID NO: 1944
  No.126  HC variable region

SEQ ID NO: 1993 - protein, 110 aa, Artificial Sequence; identical to SEQ ID NO: 1921
  No.127  LC variable region

SEQ ID NO: 1994 - protein, 128 aa, Artificial Sequence; identical to SEQ ID NO: 1922
  No.127  HC variable region

SEQ ID NO: 1995 - protein, 110 aa, Artificial Sequence
  No.128  LC variable region
ELVLTQPPSVSAAPGQKVTISCSGSTSNIGNNFVSWYQHLPGTAPKLLIYDNDKRPSGIPDRFSGSKSGTSATLGITGLQTGDEADYYCGTWDSSLSAGVFGGGTKLTVL

SEQ ID NO: 1996 - protein, 128 aa, Artificial Sequence; identical to SEQ ID NO: 1930
  No.128  HC variable region

SEQ ID NO: 1997 - protein, 110 aa, Artificial Sequence
  No.129  LC variable region
ELELTQPPSVSAAPGQKVTISCSGSNSNIGNNYVSWYQQLPGTAPKLLIYDNNKRPSGIPDRFSSSKSGTSATLGITGLQTGDEADYYCGTWDNNLSAGVFGTGTKVTVL

SEQ ID NO: 1998 - protein, 128 aa, Artificial Sequence; identical to SEQ ID NO: 1930
  No.129  HC variable region

SEQ ID NO: 1999 - protein, 110 aa, Artificial Sequence; identical to SEQ ID NO: 1943
  No.130  LC variable region

SEQ ID NO: 2000 - protein, 128 aa, Artificial Sequence; identical to SEQ ID NO: 1944
  No.130  HC variable region

SEQ ID NO: 2001 - protein, 110 aa, Artificial Sequence; identical to SEQ ID NO: 1963
  No.131  LC variable region

SEQ ID NO: 2002 - protein, 128 aa, Artificial Sequence; identical to SEQ ID NO: 1930
  No.131  HC variable region

SEQ ID NO: 2003 - protein, 110 aa, Artificial Sequence; identical to SEQ ID NO: 1935
  No.132  LC variable region

SEQ ID NO: 2004 - protein, 128 aa, Artificial Sequence; identical to SEQ ID NO: 1940
  No.132  HC variable region

SEQ ID NO: 2005 - protein, 110 aa, Artificial Sequence; identical to SEQ ID NO: 1949
  No.133  LC variable region

SEQ ID NO: 2006 - protein, 128 aa, Artificial Sequence
  No.133  HC variable region
QITLKESGPSLVKPSQTLTLTCTFSGFSLTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS

SEQ ID NO: 2007 - protein, 110 aa, Artificial Sequence; identical to SEQ ID NO: 1955
  No.134  LC variable region

SEQ ID NO: 2008 - protein, 128 aa, Artificial Sequence; identical to SEQ ID NO: 1956
  No.134  HC variable region

SEQ ID NO: 2009 - protein, 110 aa, Artificial Sequence; identical to SEQ ID NO: 1937
  No.135  LC variable region

SEQ ID NO: 2010 - protein, 128 aa, Artificial Sequence; identical to SEQ ID NO: 1938
  No.135  HC variable region

SEQ ID NO: 2011 - protein, 110 aa, Artificial Sequence; identical to SEQ ID NO: 1949
  No.136  LC variable region

SEQ ID NO: 2012 - protein, 128 aa, Artificial Sequence; identical to SEQ ID NO: 1940
  No.136  HC variable region

SEQ ID NO: 2013 - protein, 110 aa, Artificial Sequence; identical to SEQ ID NO: 1929
  No.137  LC variable region

SEQ ID NO: 2014 - protein, 128 aa, Artificial Sequence; identical to SEQ ID NO: 1930
  No.137  HC variable region

SEQ ID NO: 2015 - protein, 110 aa, Artificial Sequence
  No.138  LC variable region
ELVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTELTVL

SEQ ID NO: 2016 - protein, 128 aa, Artificial Sequence; identical to SEQ ID NO: 1930
  No.138  HC variable region

SEQ ID NO: 2017 - protein, 110 aa, Artificial Sequence; identical to SEQ ID NO: 1929
  No.139  LC variable region

SEQ ID NO: 2018 - protein, 128 aa, Artificial Sequence
  No.139  HC variable region
QITLKESGPTLVKPTQTLTLTCSFSGFSLSTSGVGVGWIRQPPGKALEWLALIDWDDNKYHTTSLKTRLTISKDTSKNQVVLTMTNMDPVDTATYYCARIPGFLRYRNRYYYYGMDVWGQGTTVTVSS

SEQ ID NO: 2019 - protein, 110 aa, Artificial Sequence; identical to SEQ ID NO: 1929
  No.140  LC variable region

SEQ ID NO: 2020 - protein, 128 aa, Artificial Sequence; identical to SEQ ID NO: 1934
  No.140  HC variable region

SEQ ID NO: 2021 - protein, 110 aa, Artificial Sequence; identical to SEQ ID NO: 1937
  No.141  LC variable region

SEQ ID NO: 2022 - protein, 128 aa, Artificial Sequence; identical to SEQ ID NO: 1938
  No.141  HC variable region

SEQ ID NO: 2023 - protein, 110 aa, Artificial Sequence; identical to SEQ ID NO: 1943
  No.142  LC variable region

SEQ ID NO: 2024 - protein, 128 aa, Artificial Sequence; identical to SEQ ID NO: 1944
  No.142  HC variable region

SEQ ID NO: 2025 - protein, 110 aa, Artificial Sequence
  No.143  LC variable region
ELVLTQPPSASGTPGQRVTISCSGSSSNIGNNYVSWYQQLPGTAPKLLIYDNNKRPSGIPDRFSGSKSGTSATLGITGLQTGDEADYYCGTWDSSLSAGVFGGGTKVTVL

SEQ ID NO: 2026 - protein, 128 aa, Artificial Sequence; identical to SEQ ID NO: 1930
  No.143  HC variable region

SEQ ID NO: 2027 - protein, 110 aa, Artificial Sequence; identical to SEQ ID NO: 1935
  No.144  LC variable region

SEQ ID NO: 2028 - protein, 128 aa, Artificial Sequence; identical to SEQ ID NO: 1940
  No.144  HC variable region

SEQ ID NO: 2029 - protein, 110 aa, Artificial Sequence; identical to SEQ ID NO: 1945
  No.145  LC variable region

SEQ ID NO: 2030 - protein, 128 aa, Artificial Sequence; identical to SEQ ID NO: 1930
  No.145  HC variable region

SEQ ID NO: 2031 - protein, 110 aa, Artificial Sequence; identical to SEQ ID NO: 1923
  No.146  LC variable region

SEQ ID NO: 2032 - protein, 128 aa, Artificial Sequence; identical to SEQ ID NO: 1924
  No.146  HC variable region

SEQ ID NO: 2033 - protein, 110 aa, Artificial Sequence
  No.147  LC variable region
ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSGGVFGGGTKVTVL

SEQ ID NO: 2034 - protein, 128 aa, Artificial Sequence
  No.147  HC variable region
QITLKESGPTLVKPSQTLTLTCTFSGFSFTTSGMGVGWIRQPPGKALEWLALIDWDDNKYYTTSLKTRLTISKDTSKNQVVLTMTNMDPVDTATYYCARIPGFLRYRNRYYYYGMDVWGQGTTVTVSS

SEQ ID NO: 2035 - protein, 110 aa, Artificial Sequence; identical to SEQ ID NO: 1949
  No.148  LC variable region

SEQ ID NO: 2036 - protein, 128 aa, Artificial Sequence; identical to SEQ ID NO: 1940
  No.148  HC variable region

SEQ ID NO: 2037 - protein, 110 aa, Artificial Sequence; identical to SEQ ID NO: 1949
  No.149  LC variable region

SEQ ID NO: 2038 - protein, 128 aa, Artificial Sequence; identical to SEQ ID NO: 2006
  No.149  HC variable region

SEQ ID NO: 2039 - protein, 110 aa, Artificial Sequence; identical to SEQ ID NO: 1923
  No.150  LC variable region

SEQ ID NO: 2040 - protein, 128 aa, Artificial Sequence; identical to SEQ ID NO: 1924
  No.150  HC variable region

SEQ ID NO: 2041 - protein, 110 aa, Artificial Sequence; identical to SEQ ID NO: 1929
  No.151  LC variable region

SEQ ID NO: 2042 - protein, 128 aa, Artificial Sequence; identical to SEQ ID NO: 1930
  No.151  HC variable region

SEQ ID NO: 2043 - protein, 110 aa, Artificial Sequence
  No.152  LC variable region
ELVLTQPPSVSAAPGQKVTISCSGRSSNIGNNYVSWYQQLPGTAPKLLIYDNNKRPSGIPDRFSGSKSGTSATLGITGLQTGDEADYYCGTWDSSLSAGVFGGGTQLTVL

SEQ ID NO: 2044 - protein, 128 aa, Artificial Sequence; identical to SEQ ID NO: 2006
  No.152  HC variable region

SEQ ID NO: 2045 - protein, 110 aa, Artificial Sequence; identical to SEQ ID NO: 1919
  No.153  LC variable region

SEQ ID NO: 2046 - protein, 128 aa, Artificial Sequence; identical to SEQ ID NO: 1966
  No.153  HC variable region

SEQ ID NO: 2047 - protein, 110 aa, Artificial Sequence; identical to SEQ ID NO: 1945
  No.154  LC variable region

SEQ ID NO: 2048 - protein, 128 aa, Artificial Sequence; identical to SEQ ID NO: 1930
  No.154  HC variable region

SEQ ID NO: 2049 - protein, 110 aa, Artificial Sequence; identical to SEQ ID NO: 1923
  No.155  LC variable region

SEQ ID NO: 2050 - protein, 128 aa, Artificial Sequence; identical to SEQ ID NO: 1924
  No.155  HC variable region

SEQ ID NO: 2051 - protein, 110 aa, Artificial Sequence; identical to SEQ ID NO: 1935
  No.156  LC variable region

SEQ ID NO: 2052 - protein, 128 aa, Artificial Sequence; identical to SEQ ID NO: 1940
  No.156  HC variable region

SEQ ID NO: 2053 - protein, 110 aa, Artificial Sequence
  No.157  LC variable region
ELELTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKVTVL

SEQ ID NO: 2054 - protein, 128 aa, Artificial Sequence; identical to SEQ ID NO: 1930
  No.157  HC variable region

SEQ ID NO: 2055 - protein, 110 aa, Artificial Sequence; identical to SEQ ID NO: 2053
  No.158  LC variable region

SEQ ID NO: 2056 - protein, 128 aa, Artificial Sequence; identical to SEQ ID NO: 1930
  No.158  HC variable region

SEQ ID NO: 2057 - protein, 110 aa, Artificial Sequence; identical to SEQ ID NO: 1929
  No.159  LC variable region

SEQ ID NO: 2058 - protein, 128 aa, Artificial Sequence; identical to SEQ ID NO: 1930
  No.159  HC variable region

SEQ ID NO: 2059 - protein, 110 aa, Artificial Sequence
  No.160  LC variable region
ELELTQPPSVSGSPGQSVTISCSGSSSNIGNNYVSWYQQLPGTAPKLLIYDNNKRPSGIPDRFSGSKSGTSATLGITGLQTGDEADYYCGTWDSSLSAGVFGGGTQLTVL

SEQ ID NO: 2060 - protein, 128 aa, Artificial Sequence; identical to SEQ ID NO: 1930
  No.160  HC variable region

SEQ ID NO: 2061 - protein, 110 aa, Artificial Sequence; identical to SEQ ID NO: 1935
  No.161  LC variable region

SEQ ID NO: 2062 - protein, 128 aa, Artificial Sequence; identical to SEQ ID NO: 1940
  No.161  HC variable region

SEQ ID NO: 2063 - protein, 110 aa, Artificial Sequence; identical to SEQ ID NO: 1945
  No.162  LC variable region

SEQ ID NO: 2064 - protein, 128 aa, Artificial Sequence; identical to SEQ ID NO: 1930
  No.162  HC variable region

SEQ ID NO: 2065 - protein, 110 aa, Artificial Sequence; identical to SEQ ID NO: 1937
  No.163  LC variable region

SEQ ID NO: 2066 - protein, 128 aa, Artificial Sequence; identical to SEQ ID NO: 1938
  No.163  HC variable region

SEQ ID NO: 2067 - protein, 110 aa, Artificial Sequence; identical to SEQ ID NO: 1919
  No.164  LC variable region

SEQ ID NO: 2068 - protein, 133 aa, Artificial Sequence
  No.164  HC variable region
QITLKESGPALVKPTQTLTLTCTFSGFSLSTSGVGVGWIRQPPGKALEWLALIDWDDNKYYTTSLKTRLTISKDTSKNQVVLTMTNMDPVDTATYYCARIPGFLRYRNRYYYYGMDVWGPRDHGHRLLSFHQG

SEQ ID NO: 2069 - protein, 110 aa, Artificial Sequence; identical to SEQ ID NO: 1935
  No.165  LC variable region

SEQ ID NO: 2070 - protein, 128 aa, Artificial Sequence; identical to SEQ ID NO: 1940
  No.165  HC variable region

SEQ ID NO: 2071 - protein, 110 aa, Artificial Sequence; identical to SEQ ID NO: 1935
  No.166  LC variable region

SEQ ID NO: 2072 - protein, 128 aa, Artificial Sequence; identical to SEQ ID NO: 1940
  No.166  HC variable region

SEQ ID NO: 2073 - protein, 110 aa, Artificial Sequence; identical to SEQ ID NO: 2059
  No.167  LC variable region

SEQ ID NO: 2074 - protein, 128 aa, Artificial Sequence; identical to SEQ ID NO: 1930
  No.167  HC variable region

SEQ ID NO: 2075 - protein, 110 aa, Artificial Sequence; identical to SEQ ID NO: 1949
  No.168  LC variable region

SEQ ID NO: 2076 - protein, 128 aa, Artificial Sequence; identical to SEQ ID NO: 1940
  No.168  HC variable region

SEQ ID NO: 2077 - protein, 110 aa, Artificial Sequence; identical to SEQ ID NO: 1945
  No.169  LC variable region

SEQ ID NO: 2078 - protein, 128 aa, Artificial Sequence; identical to SEQ ID NO: 1930
  No.169  HC variable region

SEQ ID NO: 2079 - protein, 110 aa, Artificial Sequence; identical to SEQ ID NO: 1923
  No.170  LC variable region

SEQ ID NO: 2080 - protein, 128 aa, Artificial Sequence; identical to SEQ ID NO: 1924
  No.170  HC variable region

SEQ ID NO: 2081 - protein, 110 aa, Artificial Sequence; identical to SEQ ID NO: 2043
  No.171  LC variable region

SEQ ID NO: 2082 - protein, 128 aa, Artificial Sequence; identical to SEQ ID NO: 2006
  No.171  HC variable region

SEQ ID NO: 2083 - protein, 110 aa, Artificial Sequence
  No.172  LC variable region
ELVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTAL

SEQ ID NO: 2084 - protein, 128 aa, Artificial Sequence
  No.172  HC variable region
QITLKESGPTLVKPSQTLTLTCTFSGFSLSTSGVGVGWIRQPPGKPLEWLALIDWDDNKYYTTSLKTRLTISKDTSKNQVVLTMTNMDPVDTATYYCARIPGFLRYRNRYYYYGMDVWGQGTTVTVSS

SEQ ID NO: 2085 - protein, 110 aa, Artificial Sequence; identical to SEQ ID NO: 1929
  No.173  LC variable region

SEQ ID NO: 2086 - protein, 128 aa, Artificial Sequence; identical to SEQ ID NO: 1930
  No.173  HC variable region

SEQ ID NO: 2087 - protein, 110 aa, Artificial Sequence; identical to SEQ ID NO: 1935
  No.174  LC variable region

SEQ ID NO: 2088 - protein, 128 aa, Artificial Sequence; identical to SEQ ID NO: 1940
  No.174  HC variable region

SEQ ID NO: 2089 - protein, 110 aa, Artificial Sequence; identical to SEQ ID NO: 1935
  No.175  LC variable region

SEQ ID NO: 2090 - protein, 128 aa, Artificial Sequence; identical to SEQ ID NO: 1940
  No.175  HC variable region

SEQ ID NO: 2091 - protein, 110 aa, Artificial Sequence; identical to SEQ ID NO: 1929
  No.176  LC variable region

SEQ ID NO: 2092 - protein, 128 aa, Artificial Sequence; identical to SEQ ID NO: 1930
  No.176  HC variable region

SEQ ID NO: 2093 - protein, 110 aa, Artificial Sequence; identical to SEQ ID NO: 2025
  No.177  LC variable region

SEQ ID NO: 2094 - protein, 128 aa, Artificial Sequence; identical to SEQ ID NO: 1930
  No.177  HC variable region

SEQ ID NO: 2095 - protein, 110 aa, Artificial Sequence; identical to SEQ ID NO: 1935
  No.178  LC variable region

SEQ ID NO: 2096 - protein, 128 aa, Artificial Sequence; identical to SEQ ID NO: 1940
  No.178  HC variable region

SEQ ID NO: 2097 - protein, 110 aa, Artificial Sequence; identical to SEQ ID NO: 1937
  No.179  LC variable region

SEQ ID NO: 2098 - protein, 128 aa, Artificial Sequence; identical to SEQ ID NO: 1938
  No.179  HC variable region

SEQ ID NO: 2099 - protein, 110 aa, Artificial Sequence; identical to SEQ ID NO: 1955
  No.180  LC variable region

SEQ ID NO: 2100 - protein, 128 aa, Artificial Sequence; identical to SEQ ID NO: 1956
  No.180  HC variable region

SEQ ID NO: 2101 - protein, 110 aa, Artificial Sequence; identical to SEQ ID NO: 1937
  No.181  LC variable region

SEQ ID NO: 2102 - protein, 128 aa, Artificial Sequence; identical to SEQ ID NO: 1938
  No.181  HC variable region

SEQ ID NO: 2103 - protein, 110 aa, Artificial Sequence; identical to SEQ ID NO: 2059
  No.182  LC variable region

SEQ ID NO: 2104 - protein, 128 aa, Artificial Sequence; identical to SEQ ID NO: 1930
  No.182  HC variable region

SEQ ID NO: 2105 - protein, 110 aa, Artificial Sequence; identical to SEQ ID NO: 1949
  No.183  LC variable region

SEQ ID NO: 2106 - protein, 128 aa, Artificial Sequence; identical to SEQ ID NO: 2006
  No.183  HC variable region

SEQ ID NO: 2107 - protein, 110 aa, Artificial Sequence; identical to SEQ ID NO: 1917
  No.184  LC variable region

SEQ ID NO: 2108 - protein, 128 aa, Artificial Sequence; identical to SEQ ID NO: 1918
  No.184  HC variable region

SEQ ID NO: 2109 - protein, 110 aa, Artificial Sequence; identical to SEQ ID NO: 1935
  No.185  LC variable region

SEQ ID NO: 2110 - protein, 128 aa, Artificial Sequence; identical to SEQ ID NO: 1940
  No.185  HC variable region

SEQ ID NO: 2111 - protein, 110 aa, Artificial Sequence; identical to SEQ ID NO: 2043
  No.186  LC variable region

SEQ ID NO: 2112 - protein, 128 aa, Artificial Sequence; identical to SEQ ID NO: 2006
  No.186  HC variable region

SEQ ID NO: 2113 - protein, 110 aa, Artificial Sequence; identical to SEQ ID NO: 1963
  No.187  LC variable region

SEQ ID NO: 2114 - protein, 128 aa, Artificial Sequence; identical to SEQ ID NO: 1930
  No.187  HC variable region

SEQ ID NO: 2115 - protein, 110 aa, Artificial Sequence; identical to SEQ ID NO: 1937
  No.188  LC variable region

SEQ ID NO: 2116 - protein, 128 aa, Artificial Sequence; identical to SEQ ID NO: 1938
  No.188  HC variable region

SEQ ID NO: 2117 - protein, 110 aa, Artificial Sequence; identical to SEQ ID NO: 2043
  No.189  LC variable region

SEQ ID NO: 2118 - protein, 128 aa, Artificial Sequence; identical to SEQ ID NO: 2006
  No.189  HC variable region

SEQ ID NO: 2119 - protein, 110 aa, Artificial Sequence; identical to SEQ ID NO: 1963
  No.190  LC variable region

SEQ ID NO: 2120 - protein, 128 aa, Artificial Sequence; identical to SEQ ID NO: 1930
  No.190  HC variable region

SEQ ID NO: 2121 - protein, 110 aa, Artificial Sequence; identical to SEQ ID NO: 1943
  No.191  LC variable region

SEQ ID NO: 2122 - protein, 128 aa, Artificial Sequence; identical to SEQ ID NO: 1944
  No.191  HC variable region

SEQ ID NO: 2123 - protein, 110 aa, Artificial Sequence; identical to SEQ ID NO: 1935
  No.192  LC variable region

SEQ ID NO: 2124 - protein, 128 aa, Artificial Sequence; identical to SEQ ID NO: 1940
  No.192  HC variable region

SEQ ID NO: 2125 - protein, 110 aa, Artificial Sequence; identical to SEQ ID NO: 1949
  No.193  LC variable region

SEQ ID NO: 2126 - protein, 128 aa, Artificial Sequence; identical to SEQ ID NO: 2006
  No.193  HC variable region

SEQ ID NO: 2127 - protein, 110 aa, Artificial Sequence; identical to SEQ ID NO: 1937
  No.194  LC variable region

SEQ ID NO: 2128 - protein, 128 aa, Artificial Sequence; identical to SEQ ID NO: 1938
  No.194  HC variable region

SEQ ID NO: 2129 - protein, 110 aa, Artificial Sequence
  No.195  LC variable region
ELMLTQPHSVSGSPGKTVTISCTRSSGSIASNYVQWYQQRPGSSPTTVIYEDNQRPSGVPDRFSGSIDSSSNSASLTISGLKTEDEADYYCQSYDSSDWVFGGGTKVTVL

SEQ ID NO: 2130 - protein, 120 aa, Artificial Sequence
  No.195  HC variable region
QVQLVQSGAEVKKPGASVKVSCKASGYNFTRYGISWVRQAPGQGLEWMGWISAYNGNTKYAQKLQGRVTMTTDTSTSTAYLELRSLRSDDTAVYYCARVLGIAVAGTPIWGQGTLVTVSS

SEQ ID NO: 2131 - protein, 111 aa, Artificial Sequence
  No.196  LC variable region
ELVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTQLTVL

SEQ ID NO: 2132 - protein, 124 aa, Artificial Sequence
  No.196  HC variable region
QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARVRGYSGYGSTYYFDYWGQGTLVTVSS

SEQ ID NO: 2133 - protein, 111 aa, Artificial Sequence
  No.197  LC variable region
ELVLTQPPSVSGAPGQRVTISCTGSSSNIGAGYDVHWYQQFPGTAPKLLIYGNSNRPSGVPDRFSGSKSGTSASLAITGLQAEDEADYYCQSYDSSLSGSIFGGGTKLTVL

SEQ ID NO: 2134 - protein, 124 aa, Artificial Sequence
  No.197  HC variable region
QVQLVQSGAEVKKPGSSVKVSCEASGGTFSSYAISWVRQAPGQGLEWMGGIIPILGIANYAQKFQGRVTITADKSTSTAYMELSSLRSEDTAVYYCARVRGYSGYGSTYYFDYWGQGTLVTVSS

SEQ ID NO: 2135 - protein, 111 aa, Artificial Sequence
  No.198  LC variable region
ELVLTQPPSVSGAPGQRVAISCTGSSSNIGAGYDVHWYQQLPGTAPKLLIYGNSNRPSGVPDRFSGSRSGTSASLAITGLQAEDEADYYCQSYDSSLSGSVFGGGTKLTVL

SEQ ID NO: 2136 - protein, 124 aa, Artificial Sequence; identical to SEQ ID NO: 2132
  No.198  HC variable region

SEQ ID NO: 2137 - protein, 111 aa, Artificial Sequence; identical to SEQ ID NO: 2133
  No.199  LC variable region

SEQ ID NO: 2138 - protein, 124 aa, Artificial Sequence; identical to SEQ ID NO: 2134
  No.199  HC variable region

SEQ ID NO: 2139 - protein, 111 aa, Artificial Sequence
  No.200  LC variable region
ELVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKVTVL

SEQ ID NO: 2140 - protein, 124 aa, Artificial Sequence; identical to SEQ ID NO: 2132
  No.200  HC variable region

SEQ ID NO: 2141 - protein, 111 aa, Artificial Sequence
  No.201  LC variable region
ELELTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKLTVL

SEQ ID NO: 2142 - protein, 124 aa, Artificial Sequence
  No.201  HC variable region
QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARVRGYSGYGSTYYSDYWGQGTLVTVSS

SEQ ID NO: 2143 - protein, 111 aa, Artificial Sequence; identical to SEQ ID NO: 2141
  No.202  LC variable region

SEQ ID NO: 2144 - protein, 124 aa, Artificial Sequence; identical to SEQ ID NO: 2142
  No.202  HC variable region

SEQ ID NO: 2145 - protein, 110 aa, Artificial Sequence
  No.203  LC variable region
ELVLTQSPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVL

SEQ ID NO: 2146 - protein, 127 aa, Artificial Sequence
  No.203  HC variable region
QVQLVQSGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS

SEQ ID NO: 2147 - protein, 110 aa, Artificial Sequence
  No.204  LC variable region
ELELTQPPSVSGTPGQRVTISCSGSSSNIGSKTVNWYQHLPGTAPKLLIYSNNQRPSGVPDRFSGSKSGTSASLAISGLQSEDEADYYCATWDDSLNGWVFGGGTKLTVL

SEQ ID NO: 2148 - protein, 127 aa, Artificial Sequence
  No.204  HC variable region
EVQLLESGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS

SEQ ID NO: 2149 - protein, 110 aa, Artificial Sequence
  No.205  LC variable region
ELVVTQPPSASGTPGQRVTISCSGSSSNIGSNTVNWYQQLPGTAPKLLIYSNNQRPSGVPDRFSGSKSGTSASLAISGLQSEDEADYYCATWDDSLNGWVFGGGTKVTVL

SEQ ID NO: 2150 - protein, 127 aa, Artificial Sequence
  No.205  HC variable region
QVQLVQSGGGVVQPGRSLRLSCAASGFTFSSFAMHWVRQAPGKGLEWVAVISFDGSNKYYADSVKGQFTISRDNSKNALYLQMNSLRAEDTAVYYCARGDYYGSGSYYNPSPFFDYWGQGTLVTVSS

SEQ ID NO: 2151 - protein, 110 aa, Artificial Sequence
  No.206  LC variable region
ELVVTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 2152 - protein, 127 aa, Artificial Sequence
  No.206  HC variable region
QVQLVQSGGGVVQPGRSLRLSCAASGFTFSNFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS

SEQ ID NO: 2153 - protein, 110 aa, Artificial Sequence
  No.207  LC variable region
ELVVTQPPSASGTPGQRVTISCSGSSSNIGSNTVNWYQQLPGTAPKLLIYSNNQRPSGVPDRFSGSKSGTSASLAIRGLRSEDEADYYCATWDDALSGWVFGGGTKLTVL

SEQ ID NO: 2154 - protein, 127 aa, Artificial Sequence; identical to SEQ ID NO: 2146
  No.207  HC variable region

SEQ ID NO: 2155 - protein, 110 aa, Artificial Sequence
  No.208  LC variable region
ELELTQPPSVSGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 2156 - protein, 127 aa, Artificial Sequence
  No.208  HC variable region
EVQLVQSGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS

SEQ ID NO: 2157 - protein, 110 aa, Artificial Sequence
  No.209  LC variable region
ELVLTQPPSASGTPGQRVTISCSGSSSNIGSKAVNWYQHLPGTAPKLLIYSNNQRPSGVPDRFSGSKSGTSASLAISGLQSEDEADYYCATWDDSLNGWVFGGGTKVTVL

SEQ ID NO: 2158 - protein, 127 aa, Artificial Sequence
  No.209  HC variable region
EVQLVESGGGVVQPGRSLRLSCAASGFTFSSFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS

SEQ ID NO: 2159 - protein, 110 aa, Artificial Sequence
  No.210  LC variable region
ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 2160 - protein, 127 aa, Artificial Sequence
  No.210  HC variable region
EVQLVESGGGVVQPGRSLRLSCAASGFTFSRFAMHWVRQAPGKGLEWVAVVSYDGSNNYYADSVKGRFTISRDNSKDTLYLQMNSLRAEDTAVYYCARGDYYGSGSYYNPSPFFDYWGQGTLVTVSS

SEQ ID NO: 2161 - protein, 110 aa, Artificial Sequence
  No.211  LC variable region
ELELTQPPSVSGAPGQRVTISCSGSRSNIGGNTVNWFQQLPGAVPKLLVYGDNQRPSGVPDRFSGSKSGTSASLAISGLRSEDEADYYCAAWDDSLSGWVFGGGTKVTVL

SEQ ID NO: 2162 - protein, 127 aa, Artificial Sequence
  No.211  HC variable region
QVQLVQSGGGVVQPGRSLRLSCAASGFTFSTYSMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS

SEQ ID NO: 2163 - protein, 110 aa, Artificial Sequence
  No.212  LC variable region
ELELTQPPSVSGTPGQRVTISCSGSSSNIGSNTVNWYQQLPGTAPKLLIYSNNQRPSGVPDRFSGSKSGTSASLAISGLQSEDEADYYCAAWEDSLNGYVFGTGTKVTVL

SEQ ID NO: 2164 - protein, 127 aa, Artificial Sequence
  No.212  HC variable region
EVQLVQSGGGVVRPGRSLRLSCAASGFTFSNFAMHWVRQAPGKGLEWVAVISYDGSNKYYADSVKGRFTISRDNSKNTLYLQMNSLRPEDTAVYYCARGDYYGSGSYYNPSPFFDYWGQGTLVTVSS

SEQ ID NO: 2165 - protein, 110 aa, Artificial Sequence
  No.213  LC variable region
ELELTQPPSVSGTPGQRVTISCSGSSSNIGSNTVNWYQQLPGTAPKLLIYSNNQRPSGVPDRFSGSKSGTSASLAISGLRSEDEADYYCAAWDDSLSGWVFGGGTKVTVL

SEQ ID NO: 2166 - protein, 127 aa, Artificial Sequence; identical to SEQ ID NO: 2146
  No.213  HC variable region

SEQ ID NO: 2167 - protein, 110 aa, Artificial Sequence
  No.214  LC variable region
ELMLTQPHSASGTPGQRVTISCSGSSSNIGSNTVNWFQQLPGTAPKLLIYSNNQRPSGVPDRFSGSKSGTSASLAISGLRSEDEADYYCATWDDTLDSWVFGGGTKLTVL

SEQ ID NO: 2168 - protein, 127 aa, Artificial Sequence
  No.214  HC variable region
EVQLVESGGGVVQPGRSLRLSCPASGFTFSNFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS

SEQ ID NO: 2169 - protein, 110 aa, Artificial Sequence; identical to SEQ ID NO: 2145
  No.215  LC variable region

SEQ ID NO: 2170 - protein, 127 aa, Artificial Sequence
  No.215  HC variable region
EVQLLESGGGVVQPGRSLRLSCAASGFTFSSFAMHWVRQAPGKGLEWVAVISFDGSNKYYADSVKGQFTISRDNSKNTLYLQMNSLRAEDTAVYYCARGDYYGSGSYYNPSPFFDYWGQGTLVTVSS

SEQ ID NO: 2171 - protein, 110 aa, Artificial Sequence; identical to SEQ ID NO: 2159
  No.216  LC variable region

SEQ ID NO: 2172 - protein, 127 aa, Artificial Sequence
  No.216  HC variable region
EVQLVESGGGVVQPGRSLRLSCAASGFTFSSFAMHWVRQAPGKGLEWVAVISYDGSNKYYADSVKGRFTISRDNSKNTLYLQMNSLRPEDTAVYYCARGDYYGSGSYYNPSPFFDYWGQGTLVTVSS

SEQ ID NO: 2173 - protein, 110 aa, Artificial Sequence
  No.217  LC variable region
ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNVWVFGGGTKVTVL

SEQ ID NO: 2174 - protein, 127 aa, Artificial Sequence
  No.217  HC variable region
EVQLVESGGGVVQPGRSLRLSCAASGFTFSRFAMHWVRQAPGKGLEWVAVVSYDGSNNYYADSVKGRFTISRDNSKNTLYLQMNSLRAEDTAVYYCARGDYYGSGSYYNPSPFFDYWGQGTLVTVSS

SEQ ID NO: 2175 - protein, 110 aa, Artificial Sequence
  No.218  LC variable region
ELELTQPPSVSGTPGQRVSISCSGSTSNIGSNPVNWFQQLPGTAPKLLIYSNNQRPSGVPNRFSGSKSGTSASLAISGLQSDDEADYYCAAWDDSLNGWVFGGGTKVTVL

SEQ ID NO: 2176 - protein, 127 aa, Artificial Sequence
  No.218  HC variable region
QVQLVQSGGGVVQPGRSLRLSCAASGFTFSSFAMHWVRQAPGKGLEWVAVISFDGSNKYYADSVKGQFTISRDNSKNTLYLQMNSLRAEDTAVYYCARGDYYGSGSYYNPSPFFDYWGQGTLVTVSS

SEQ ID NO: 2177 - protein, 110 aa, Artificial Sequence
  No.219  LC variable region
ELVLTQPPSASGTPGQRVTISCSGSSSNIGSNTVNWYQQFPGAAPKLLIYSNSQRPSGVPDRVSASKSGTSASLAISGLQSEDEGDYYCAGWDDSLNGWVFGGGTKLTVL

SEQ ID NO: 2178 - protein, 127 aa, Artificial Sequence; identical to SEQ ID NO: 2174
  No.219  HC variable region

SEQ ID NO: 2179 - protein, 110 aa, Artificial Sequence
  No.220  LC variable region
ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKVTVL

SEQ ID NO: 2180 - protein, 127 aa, Artificial Sequence
  No.220  HC variable region
QVQLVQSGGGVVQPGRSLRLSCPASGFTFSNFAMHWVRQAPGKGLEWVAVISYDGSNKYFADSVKGRFTISRDNSKNTLYLQMSSLRAEDTAVYYCARGDYYGSGSYYNPSPFFDYWGQGTLVTVSS

SEQ ID NO: 2181 - protein, 110 aa, Artificial Sequence
  No.221  LC variable region
ELVLTQPPSVSGTPGQRVTISCSGSSSNIGSNTVNWYQQLPGTAPKLLIYSNNQRPSGVPDRFSGSKSGTSASLAISGLRSDDEADYYCATWDDSLSGWVFGGGTQLTVL

SEQ ID NO: 2182 - protein, 127 aa, Artificial Sequence
  No.221  HC variable region
QVQLVQSGGGVVQPGRSLRLSCAASGFTFSRFAMHWVRQAPGKGLEWVAVVSYDGSNNYYADSVKGRSTISRDNSKNTLYLQMNSLRAEDTAVYYCARGDYYGSGSYYNPSPFFDYWGQGTLVTVSS

SEQ ID NO: 2183 - protein, 110 aa, Artificial Sequence; identical to SEQ ID NO: 2153
  No.222  LC variable region

SEQ ID NO: 2184 - protein, 127 aa, Artificial Sequence; identical to SEQ ID NO: 2146
  No.222  HC variable region

SEQ ID NO: 2185 - protein, 110 aa, Artificial Sequence
  No.223  LC variable region
ELELTQPPSVSGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTQLTVL

SEQ ID NO: 2186 - protein, 127 aa, Artificial Sequence; identical to SEQ ID NO: 2148
  No.223  HC variable region

SEQ ID NO: 2187 - protein, 110 aa, Artificial Sequence
  No.224  LC variable region
ELELTQPPSVSGTPGQRVTISCSGSSSNIGSNTVNWYQQLPGTAPKLLIYSNNQRPSGVPDRFSGSKSGTSASLAISGLRSEDEADYYCATWDSSLSAWVFGGGTKLTVL

SEQ ID NO: 2188 - protein, 127 aa, Artificial Sequence
  No.224  HC variable region
EVQLVESGGGVVQPGRSLRLSCAASGFTFSSYSMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS

SEQ ID NO: 2189 - protein, 110 aa, Artificial Sequence
  No.225  LC variable region
ELVLTQSPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKVTVL

SEQ ID NO: 2190 - protein, 127 aa, Artificial Sequence
  No.225  HC variable region
EVQLVESGGGVVQPGRSLRLSCAASGFTFSTYSMHWIRQAPGKGLEWVAVISYDGSNKYYADSVKGRFTISRDNSKNTLYLQMNSLRAEDTAVYYCARGDYYGSGSYYNPSPFFDYWGQGTLVTVSS

SEQ ID NO: 2191 - protein, 110 aa, Artificial Sequence; identical to SEQ ID NO: 2159
  No.226  LC variable region

SEQ ID NO: 2192 - protein, 127 aa, Artificial Sequence
  No.226  HC variable region
QVQLVQSGGGVVQPGRSLRLSCAASGFTFSNFAMHWVRQAPGKGLEWVAVISYDGSNKYFADSVKGRFTISRDNSKNTLYLQMSSLRAEDTAVYYCARGDYYGSGSYYNPSPFFDYWGQGTLVTVSS

SEQ ID NO: 2193 - protein, 110 aa, Artificial Sequence; identical to SEQ ID NO: 2179
  No.227  LC variable region

SEQ ID NO: 2194 - protein, 127 aa, Artificial Sequence
  No.227  HC variable region
EVQLVQSGGGVVQPGRSLRLSCAASGFTFSNFAMHWVRQAPGKGLEWVAVISYDGSNKYYADSVKGRFTISRDNSKNTLYLQMNSLRPEDTAVYYCARGDYYGSGSYYNPSPFFDYWGQGTLVTVSS

SEQ ID NO: 2195 - protein, 110 aa, Artificial Sequence
  No.228  LC variable region
ELVLTQPPSASGTPGQRVTLSCSGSSSNVGSNTVNWYQQLPGTAPKLLIYSNDQRPSGVPDRFSGSKSGTSASLAISGLQSGDEADYYCATWDDSLNGWVFGGGTKLTVL

SEQ ID NO: 2196 - protein, 127 aa, Artificial Sequence
  No.228  HC variable region
EVQLVQSGGGVVQPGRSLRLSCAASGFTFSSFAMHWVRQAPGKGLEWVAVISFDGSNKYYADSVKGQFTISRDNSKNTLYLQMNSLRAEDTAVYYCARGDYYGSGSYYNPSPFFDYWGQGTLVTVSS

SEQ ID NO: 2197 - protein, 110 aa, Artificial Sequence
  No.229  LC variable region
ELVVTQPPSVSGAPGQRVTISCSGSSSNIGSNTVNWYQQLPGTAPKLLIYSNNQRPSGVPDRFSGSKSGTSASLAISGLRSEDEADYYCAAWDDSLSGWVFGGGTKLTVL

SEQ ID NO: 2198 - protein, 127 aa, Artificial Sequence; identical to SEQ ID NO: 2148
  No.229  HC variable region

SEQ ID NO: 2199 - protein, 110 aa, Artificial Sequence
  No.230  LC variable region
ELVLTQPPSASGTPGQRVTISCSGSSSNIGSNTVNWYQQLPGTAPKLLIYSSNQRPSGVPDRFSGSKSGTSASLAISGLQSEDEADYYCAAWDDSLNGWVFGGGTKLTVL

SEQ ID NO: 2200 - protein, 127 aa, Artificial Sequence
  No.230  HC variable region
QVQLVQSGGGVVQPGRSLRLSCAASGFTFSNFAMHWVRQAPGKGLEWVAVISYDGSNKYYADSVKGRFTISRDNFKNTLYLQMNSLRAEDTAVYYCARGDYYGSGSYYNPSPFFDYWGQGTLVTVSS

SEQ ID NO: 2201 - protein, 110 aa, Artificial Sequence
  No.231  LC variable region
ELVLTQPPSASGTPGQRVTISCSGSSSNIGSNTVNWYQQLPGTAPKLLIYSNNQRPSGVPDRFSGSKSGTSASLAISGLQSEDEADYYCATWDDSLNGWVFGGGTKLTVL

SEQ ID NO: 2202 - protein, 127 aa, Artificial Sequence; identical to SEQ ID NO: 2170
  No.231  HC variable region

SEQ ID NO: 2203 - protein, 110 aa, Artificial Sequence
  No.232  LC variable region
ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNAWVFGGGTKLTVL

SEQ ID NO: 2204 - protein, 127 aa, Artificial Sequence; identical to SEQ ID NO: 2188
  No.232  HC variable region

SEQ ID NO: 2205 - protein, 110 aa, Artificial Sequence
  No.233  LC variable region
ELELTQPPSVSGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKLTVL

SEQ ID NO: 2206 - protein, 127 aa, Artificial Sequence; identical to SEQ ID NO: 2146
  No.233  HC variable region

SEQ ID NO: 2207 - protein, 110 aa, Artificial Sequence
  No.234  LC variable region
ELVLTQPPSASGTPGQRVTISCSGSSSNIGSNTVNWFQQLPGTAPKLLIYSNNQRPSGVPDRFSGSKSGTSASLAISGLQSEDEADYYCAAWDDSLNGYVFGTGTKVTVL

SEQ ID NO: 2208 - protein, 127 aa, Artificial Sequence; identical to SEQ ID NO: 2146
  No.234  HC variable region

SEQ ID NO: 2209 - protein, 110 aa, Artificial Sequence; identical to SEQ ID NO: 2205
  No.235  LC variable region

SEQ ID NO: 2210 - protein, 127 aa, Artificial Sequence
  No.235  HC variable region
QVQLVQSGGGVVQPGRSLRLSCAASGFTFSSYAMHWVRQAPGKGLEWVAVISFDGSNKYYADSVKGQFTISRDNSKNTLYLQMNSLRAEDTAVYYCARGDYYGSGSYYNPSPFFDYWGQGTLVTVSS

SEQ ID NO: 2211 - protein, 110 aa, Artificial Sequence
  No.236  LC variable region
ELVLTQPPSASGTPGQRVTISCSGSSSNIGSNTVNWYQQLPGTAPKLLIYSNNQRPSGVPDRFSGSKSGTSASLAISGLQPEDEADYYCGTWDSNSETWVFGGGTKLTVL

SEQ ID NO: 2212 - protein, 127 aa, Artificial Sequence
  No.236  HC variable region
EVQLLESRGGVVQPGRSLRLSCAASGFTFSTYSMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS

SEQ ID NO: 2213 - protein, 110 aa, Artificial Sequence
  No.237  LC variable region
ELVVTQPPSVSAAPGQKVTISCSGSNSNIGSNTVNWYQQLPGTAPKLLIYSNNQRPSGVPDRFSGSKSGTSASLAISGLQSEDEADYYCAAWDDSLNGYVFGTGTKVTVL

SEQ ID NO: 2214 - protein, 127 aa, Artificial Sequence
  No.237  HC variable region
EVQLLESGGGVVQPGRSLRLSCAASGFTFGSFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS

SEQ ID NO: 2215 - protein, 110 aa, Artificial Sequence; identical to SEQ ID NO: 2189
  No.238  LC variable region

SEQ ID NO: 2216 - protein, 127 aa, Artificial Sequence
  No.238  HC variable region
EVQLVESGGGVVQPGRSLRLSCAASGFTFSTYSMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS

SEQ ID NO: 2217 - protein, 110 aa, Artificial Sequence
  No.239  LC variable region
DLVLTQPPSASGTPGQRVTMSCSGSSSNIGSKTVNWYQQLPGTAPKLLIYSNNQRPSGVPDRFSGSKSGTSASLAISGLRSEDEADYYCAAWDDSLSGWVFGGGTQLTVL

SEQ ID NO: 2218 - protein, 127 aa, Artificial Sequence
  No.239  HC variable region
EVQLVESGGGLVQPGGSLRLSCAASGFTFSNFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS

SEQ ID NO: 2219 - protein, 110 aa, Artificial Sequence
  No.240  LC variable region
ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLSGWVFGGGTKLTVL

SEQ ID NO: 2220 - protein, 127 aa, Artificial Sequence
  No.240  HC variable region
EVQLLESGGGVVQPGRSLRLPCAASGFTFSNFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS

SEQ ID NO: 2221 - protein, 110 aa, Artificial Sequence
  No.241  LC variable region
ELVLTQPPSASGTPGQRVTISCSGSSSNIGINSVNWYQQLPGTAPKLLIYSNNQRPSGVLDRFSGSKSGTSASLAISGLQSEDEADYYCAAWDDSLNGYVFGTGTKLTVL

SEQ ID NO: 2222 - protein, 127 aa, Artificial Sequence
  No.241  HC variable region
QVQLVQSGGGVVQPGRSLRLSCAASGFTFSSFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS

SEQ ID NO: 2223 - protein, 110 aa, Artificial Sequence
  No.242  LC variable region
ELVLTQPPSASGTPGQRVTISCSGSSSNIGSKTVNWYQHLPGTAPKLLIYSNNQRPSGVPDRFSGSKSGTSASLAISGLQSEDEADYYCATWDDSLNGWVFGGGTKVTVL

SEQ ID NO: 2224 - protein, 127 aa, Artificial Sequence
  No.242  HC variable region
EVQLLESGGGVVQPGRSLRLSCAASGFTFSSFAMHWVRQAPGKGLEWVAVISYDGSNKYYAESVKGRFTVSRDNSKNTLYLQMNSLRAEDTAVYYCARGDYYGSGSYYNPSPFFDYWGQGTLVTVSS

SEQ ID NO: 2225 - protein, 110 aa, Artificial Sequence
  No.243  LC variable region
ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLSGWVFGGGTKVTVL

SEQ ID NO: 2226 - protein, 127 aa, Artificial Sequence
  No.243  HC variable region
EVQLLESGGGVVQPGRSLRLSCAASGFTFSSFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS

SEQ ID NO: 2227 - protein, 110 aa, Artificial Sequence; identical to SEQ ID NO: 2205
  No.244  LC variable region

SEQ ID NO: 2228 - protein, 127 aa, Artificial Sequence
  No.244  HC variable region
EVQLLESGGGVVQPGRSLRLSCAASGFTFSNFAMHWVRQAPGKGLEWVAVISYDGSNKYYADSVKGRFTISRDNSKNTLYLQMNSLRAEDTAVYYCARGDYYGSGSYYNPSPFFDYWGQGTLVTVSS

SEQ ID NO: 2229 - protein, 110 aa, Artificial Sequence
  No.245  LC variable region
ELVLTQPPSVSGTPGQRVTISCSGSSSNIGSNTVNWYQQLPGTAPKLLIYSNNQRPSGVPDRFSGSKSGTSASLAISGLQSEDEADYYCATWDDSLNAWVFGGGTKLTVL

SEQ ID NO: 2230 - protein, 127 aa, Artificial Sequence; identical to SEQ ID NO: 2156
  No.245  HC variable region

SEQ ID NO: 2231 - protein, 110 aa, Artificial Sequence
  No.246  LC variable region
ELVVTQPPSASGTPGQRVTISCSGSSSNIGSNTVNWYQQLPGTAPKLLIYSNNQRPSGVPDRFSGSKSGTSASLAISGLQSEDEADYYCATWDDSLNGYVFGPGTKLTVL

SEQ ID NO: 2232 - protein, 127 aa, Artificial Sequence; identical to SEQ ID NO: 2146
  No.246  HC variable region

SEQ ID NO: 2233 - protein, 109 aa, Artificial Sequence
  No.247  LC variable region
ELVLTQSPSASGTPGQRVTISCSGSSSNIGSNTVNWYQQLPGTAPKLLIYSNQRPSGVPDRFSGSKSGTSASLAISGLQSEDEADYYCAAWDDSLSGWVFGGGTELTVL

SEQ ID NO: 2234 - protein, 127 aa, Artificial Sequence; identical to SEQ ID NO: 2174
  No.247  HC variable region

SEQ ID NO: 2235 - protein, 110 aa, Artificial Sequence; identical to SEQ ID NO: 1979
  No.248  LC variable region

SEQ ID NO: 2236 - protein, 128 aa, Artificial Sequence; identical to SEQ ID NO: 1980
  No.248  HC variable region

SEQ ID NO: 2237 - protein, 108 aa, Artificial Sequence
  No.249  LC variable region
ELELTQPPSVSVAPGKTARITCGGNNIGSKSVHWYQQKPGQAPVLVIYYDSDRPSGIPERFSGSNSGNTATLTISRVEAGDEADYYCQVWDGSSDHYVFGTGTKVTVL

SEQ ID NO: 2238 - protein, 122 aa, Artificial Sequence
  No.249  HC variable region
VQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKLSHGVVGAQDAFDIWGQGTMVTVSS

SEQ ID NO: 2239 - protein, 111 aa, Artificial Sequence
  No.250  LC variable region
ELELTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTQLTVL

SEQ ID NO: 2240 - protein, 123 aa, Artificial Sequence
  No.250  HC variable region
QVQLVQSGAEVKKPGSSVKVSCKASGGTFSSYAISWVRQAPGQGLEWMGRIIPILGIANYAQKFQGRVTITADKSTSTAYMELSSLRSEDTAVYYCAREEATTGINTNWFDPWGQGTLVTVSS

SEQ ID NO: 2241 - protein, 110 aa, Artificial Sequence
  No.251  LC variable region
ELVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKLTVL

SEQ ID NO: 2242 - protein, 122 aa, Artificial Sequence
  No.251  HC variable region
EVQLLESGGGLVQPGRTLRLSCAASGFTFDDYAMHWVRQPPGKGLEWVSGIDWNSGLIGYADAVKGRFTLSRDNAKNSIFLQMNSLRAEDTALYYCVKDMGSTGGYYGMDVWGQGTTVTVSS

SEQ ID NO: 2243 - protein, 110 aa, Artificial Sequence
  No.252  LC variable region
ELELTQPPSVSGTPGQRVTISCSGSSSNIGSNTVNWYQQLPGTAPKLLIYSNNQRPSGVPDRFSGSKSGTSASLAISGLQSEDEADYYCAAWDDSLNGPVFGGGTKVTVL

SEQ ID NO: 2244 - protein, 122 aa, Artificial Sequence
  No.252  HC variable region
EVQLVESGGGVVQPGRSLRLSCAASGFTFDDYAMHWVRQPPGKGLEWVSGIDWNSGLIGYADAVKGRFTLSRDNAKNSIFLQMNSLRAEDTALYYCVKDMGSTGGYYGMDVWGQGTTVTVSS

SEQ ID NO: 2245 - protein, 110 aa, Artificial Sequence
  No.253  LC variable region
ELELTQPPSVSGTPGQRVTISCSGSSSNIGSNTVNWYQHLPGTAPKLLIYSNNQRPSGVPDRFSGSKSGTSASLAISGLQSEDEADYYCAAWDDSLNGVVFGGGTKVTVL

SEQ ID NO: 2246 - protein, 122 aa, Artificial Sequence; identical to SEQ ID NO: 2242
  No.253  HC variable region

SEQ ID NO: 2247 - protein, 108 aa, Artificial Sequence
  No.254  LC variable region
ELELTQPPSVSVAPGKTARITCGGNNIGSKSVHWYQQKPGQAPVLVIYYDSDRPSGIPERFSGSNSGNTATLTISRVEAGDEADYYCQVWDSSSDHPVFGGGTELTVL

SEQ ID NO: 2248 - protein, 122 aa, Artificial Sequence
  No.254  HC variable region
QVQLVQSGGGLVQPGRSLRLSCAASGFTFDDYAMHWVRQPPGKGLEWVSGIDWNSGLIGYADAVKGRFTLSRDNAKNSIFLQMNSLRAEDTALYYCVKDMGSTGGYYGMDVWGQGTTVTVSS

SEQ ID NO: 2249 - protein, 112 aa, Artificial Sequence
  No.255  LC variable region
ELMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNHAVFGGGTQLTVLG

SEQ ID NO: 2250 - protein, 122 aa, Artificial Sequence
  No.255  HC variable region
EVQLVESGGGLVQPGRSLRLSCAASGFTFDDYAMHWVRQPPGKGLEWVSGIDWNSGLIGYADAVKGRFTLSRDNAKNSIFLQMNSLRAEDTALYYCVKDMGSTGGYYGMDVWGQGTTVTVSS

SEQ ID NO: 2251 - protein, 110 aa, Artificial Sequence; identical to SEQ ID NO: 1937
  No.256  LC variable region

SEQ ID NO: 2252 - protein, 122 aa, Artificial Sequence
  No.256  HC variable region
EVQLVESGGGLVQPGRTLRLSCAASGFTFDDYAMHWVRQPPGKGLEWVSGIDWNSGLIGYADAVKGRFTLSRDNAKNSIFLQMNSLRAEDTALYYCVKDMGSTGGYYGMDVWGQGTTVTVSS

SEQ ID NO: 2253 - protein, 110 aa, Artificial Sequence
  No.257  LC variable region
ELELTQPPSVSGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKVTVL

SEQ ID NO: 2254 - protein, 122 aa, Artificial Sequence; identical to SEQ ID NO: 2242
  No.257  HC variable region

SEQ ID NO: 2255 - protein, 110 aa, Artificial Sequence
  No.258  LC variable region
ELVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTQLTVL

SEQ ID NO: 2256 - protein, 122 aa, Artificial Sequence
  No.258  HC variable region
EVQLVESGGGLVQPGRSLRLSCAASGFTFGDYAMHWVRQPPGKGLEWVSGIDWNSGLIGYADAVKGRFTLSRDNAKNSIFLQMNSLRAEDTALYYCVKDMGSTGGYYGMDVWGQGTTVTVSS

SEQ ID NO: 2257 - protein, 110 aa, Artificial Sequence; identical to SEQ ID NO: 2241
  No.259  LC variable region

SEQ ID NO: 2258 - protein, 122 aa, Artificial Sequence
  No.259  HC variable region
QVQLVQSGGGLVQPGRSLRLSCAASGFTFGDYAMHWVRQAPGKGLEWVSGIDWNSGLIGYADAVKGRFTLSRDNAKNSIFLQMNSLRAEDTALYYCVKDMGSTGGYYGMDVWGQGTTVTVSS

SEQ ID NO: 2259 - protein, 110 aa, Artificial Sequence
  No.260  LC variable region
ELVLTQPPSASGTPGQRVTISCSGSSSNIGSNTVNWYQQLPGTAPKLLIYTNNQRPSGVPDRFSGSKSGTSASLAISGLQSEDEADYYCAAWDDSLNGLVFGGGTELTVL

SEQ ID NO: 2260 - protein, 122 aa, Artificial Sequence
  No.260  HC variable region
EVQLVESGGGLVQPGRTLRLSCAASGFTFDDYAMHWVRQPPGKGLEWVSGIDWNSGLIGYADAVKGRFTLSRDNAKNSIFLQMNSLRAEDTALYYCVKDMGSTGGYYGMDVWGQGTTVIVSS

SEQ ID NO: 2261 - protein, 110 aa, Artificial Sequence
  No.261  LC variable region
ELVVTQPPSVSAAPGQKVTISCSGSSSNIGNNYVSWYQQLPGTAPKLLIYDNDKRPSGIPDRFSGSKSGTSATLGITGLQTGDEADYYCGTWDSSLSAYVFGTGTKVTVL

SEQ ID NO: 2262 - protein, 122 aa, Artificial Sequence
  No.261  HC variable region
EVQLLESGGGLVQPGRSLRLSCAASGFTFDDYAMHWVRQPPGKGLEWVSGIDWNSGLIGYADAVKGRFTLSRDNAKNSIFLQMNSLRAEDTALYYCVKDMGSTGGYYGMDVWGQGTTVTVSS

SEQ ID NO: 2263 - protein, 110 aa, Artificial Sequence
  No.262  LC variable region
ELELTQPPSVSGTPGQRVTISCSGSSSNIGSNTVNWYQQLPGTAPKLLIYSNNQRPSGVPDRFSGSKSGTSASLAISGLRSEDEADYYCQSYDSSLSGYVFGTGTKLTVL

SEQ ID NO: 2264 - protein, 122 aa, Artificial Sequence; identical to SEQ ID NO: 2242
  No.262  HC variable region

SEQ ID NO: 2265 - protein, 110 aa, Artificial Sequence
  No.263  LC variable region
ELVLTQPPSVSAAPGQKVTISCSGSSPNIGNNYVSWYQQLPGTAPKLLIYDNNKRPSGIPDRFSGSKSGTSATLGITGLQTGDEADYYCGTWDSSLSAYVFGTGTKLTVL

SEQ ID NO: 2266 - protein, 122 aa, Artificial Sequence; identical to SEQ ID NO: 2252
  No.263  HC variable region

SEQ ID NO: 2267 - protein, 110 aa, Artificial Sequence
  No.264  LC variable region
ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKLTVL

SEQ ID NO: 2268 - protein, 122 aa, Artificial Sequence; identical to SEQ ID NO: 2252
  No.264  HC variable region

SEQ ID NO: 2269 - protein, 110 aa, Artificial Sequence
  No.265  LC variable region
ELVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVFGGGTQLTVL

SEQ ID NO: 2270 - protein, 117 aa, Artificial Sequence
  No.265  HC variable region
EVQLLESGGGLVQPGGSLRLSCAASGFTVSSNYMTWVRQAPGKGLEWVSVIYSGGSTFYADSVKGRFTISRDNSKNTLYLQMNSLRAEDTAVYYCARDLVVYGMDVWGQGTTVTVSS

SEQ ID NO: 2271 - protein, 108 aa, Artificial Sequence
  No.266  LC variable region
ELELTQPPSVSVAPGKTARITCGGNNIGSKSVHWYQQKPGQAPVLVIYYDSDRPSGIPERFSGSNSGNTATLTISRVEAGDEADYYCQVRDSSSDHPVFGGGTKVTVL

SEQ ID NO: 2272 - protein, 117 aa, Artificial Sequence
  No.266  HC variable region
EVQLVESGGGLVQPGGSLRLSCAASGFTVSSNYMTWVRQAPGKGLEWVSVIYSGGSTFYADSVKGRFTISRDNSKNTLYLQMNSLRAEDTAVYYCARDLVVYGMDVWGQGTTVTVSS

SEQ ID NO: 2273 - protein, 110 aa, Artificial Sequence
  No.267  LC variable region
ELELTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVFGGGTKVTVL

SEQ ID NO: 2274 - protein, 117 aa, Artificial Sequence; identical to SEQ ID NO: 2272
  No.267  HC variable region

SEQ ID NO: 2275 - protein, 111 aa, Artificial Sequence
  No.268  LC variable region
ELELTQPPSVSGAPGQRVTISCTGSDSNIGAGYDVHWYQQLPGTAPKLLIYNNNNRPSGVPDRFSGSKSGTSASLAITGLQAEDEADYFCQSSDSGLTGWVFGGGTKLTVL

SEQ ID NO: 2276 - protein, 117 aa, Artificial Sequence
  No.268  HC variable region
QVQLVQSGGGVVQPGRSLRLSCAASGFTVSSNYMTWVRQAPGKGLEWVSVIYSGGSTFYADSVKGRFTISRDNSKNTLYLQMNSLRAEDTAVYYCARDLVVYGMDVWGQGTTVTVSS

SEQ ID NO: 2277 - protein, 110 aa, Artificial Sequence; identical to SEQ ID NO: 2153
  No.269  LC variable region

SEQ ID NO: 2278 - protein, 127 aa, Artificial Sequence; identical to SEQ ID NO: 2146
  No.269  HC variable region

SEQ ID NO: 2279 - protein, 107 aa, Artificial Sequence
  No.270  LC variable region
ELVLTQSPGTLSLSPGERATLSCRASQSVSSYLAWYQQKPGQAPRLLIYDASNRATGIPARFSGSGSGTDFTLTISSLEPEDFAVYYCQQYGSSPLTFGGGTKVDIK

SEQ ID NO: 2280 - protein, 117 aa, Artificial Sequence
  No.270  HC variable region
QVQLVQSGGGLVQPGGSLRLSCAASGLTVSSNYMTWVRQAPGKGLEWVSVIYSGGSTFYADSVKGRFTISRDNSKNTLYLQMNSLRAEDTAVYYCARDLVVYGMDVWGQGTTVTVSS

SEQ ID NO: 2281 - protein, 109 aa, Artificial Sequence
  No.271  LC variable region
ELELTQPPSASGTPGQRVTISCSGSSSNIGSNTVNWYQQLPGTAPKLLIYSNNQRPSGVPDRFSGSKSGTSASLAISGLQSEDEADYYCSSYAGSNNLVFGGGTKLTVL

SEQ ID NO: 2282 - protein, 117 aa, Artificial Sequence; identical to SEQ ID NO: 2272
  No.271  HC variable region

SEQ ID NO: 2283 - protein, 111 aa, Artificial Sequence
  No.272  LC variable region
ELVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKVTVL

SEQ ID NO: 2284 - protein, 117 aa, Artificial Sequence; identical to SEQ ID NO: 2272
  No.272  HC variable region

SEQ ID NO: 2285 - protein, 107 aa, Artificial Sequence; identical to SEQ ID NO: 2279
  No.273  LC variable region

SEQ ID NO: 2286 - protein, 117 aa, Artificial Sequence; identical to SEQ ID NO: 2280
  No.273  HC variable region

SEQ ID NO: 2287 - protein, 110 aa, Artificial Sequence
  No.274  LC variable region
ELELTQPPSVSGAPGQRVTISCTGSSSNIGAGYDVHWYQQLPGTAPKLLIYGNSNRPSGVPDRFSGSKSGTSASLAITGLQAEDEADYYCQSYDSSLGVVFGGGTKVTVL

SEQ ID NO: 2288 - protein, 117 aa, Artificial Sequence; identical to SEQ ID NO: 2272
  No.274  HC variable region

SEQ ID NO: 2289 - protein, 108 aa, Artificial Sequence
  No.275  LC variable region
ELVLTQPPSVSVAPGKTARITCGGNNIGSNTVNWYQQLPGTAPKLLIYSNNLRPSGVPDRFSGSKSGTSASLAISGLQSEDEADYYCAAWDDSLNGPVFGGGTKVTVL

SEQ ID NO: 2290 - protein, 117 aa, Artificial Sequence; identical to SEQ ID NO: 2272
  No.275  HC variable region

SEQ ID NO: 2291 - protein, 109 aa, Artificial Sequence
  No.276  LC variable region
ELELTQPPSASGAPGQRVTISCSGSSSNIGGSDVGWYQHLPGMAPRLLIYKSNQRPSGVPDRFSASKSGTSASLAISGLQSEDEGDYYCATWDDRLNWVFGGGTKVTVL

SEQ ID NO: 2292 - protein, 117 aa, Artificial Sequence
  No.276  HC variable region
QVQLVQSGGGLVQPGGSLRLSCAASGFTVSSNYMTWVRQAPGKGLEWVSVIYSGGSTFYADSVKGRFTISRDNSKNTLYLQMNSLRAEDTAVYYCARDLVVYGMDVWGQGTTVTVSS

SEQ ID NO: 2293 - protein, 107 aa, Artificial Sequence; identical to SEQ ID NO: 1741
  No.277  LC variable region

SEQ ID NO: 2294 - protein, 122 aa, Artificial Sequence
  No.277  HC variable region
EVQLVQSGAEVKKPGASVKVSCKASGYTFTNYYMHWVRQAPGQGLEWMGIINPSGGSTSYAQKFQGRVTMTRDTSTSTVYMELSSLRSEDTAVYYCARGGIAPYTRGAFDYWGQGTLVTVSS

SEQ ID NO: 2295 - protein, 107 aa, Artificial Sequence
  No.278  LC variable region
ELQMTQSPSSLSASVGDRVTITCQAGQDISNYLNWYQQKPGKAPKLLIYKASSLESGVPSRFSGSGSGTDFTLTISSLQPEDFATYYCQQAHSFPFTFGPGTKVDIK

SEQ ID NO: 2296 - protein, 122 aa, Artificial Sequence
  No.278  HC variable region
EVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCARGGIAPYTRGAFDYWGQGTLVTVSS

SEQ ID NO: 2297 - protein, 107 aa, Artificial Sequence
  No.279  LC variable region
ELTLTQSPSSLSASVGDRVTITCQASQDISNYLNWYQQKPGKAPKLLIYDASNLETGVPSRFSGSGSGTDFTLTISSLQPEDFATYYCQQSYSTLPTFGQGTRLEIK

SEQ ID NO: 2298 - protein, 122 aa, Artificial Sequence
  No.279  HC variable region
EVQLLESGAEVKKPGASVKVSCKASGYTFTSYYMHWVRQAPGQGLEWMGIINPSGGSTSYAQKFQGRVTMTRDTSTSTVYMELSSLRSEDTAVYYCARGGIAPYTRGAFDYWGQGTLVTVSS

SEQ ID NO: 2299 - protein, 111 aa, Artificial Sequence
  No.280  LC variable region
ELVLTQPPSVSGAPGQRVTISCTGSSSNTGAGYDVHWYQQLPGTAPKLLIYSNNQRPSGVPDRFSGSKSGTSASLAISGLQSEDEADYYCAAWDDSLNGGVFGGGTKVTVL

SEQ ID NO: 2300 - protein, 117 aa, Artificial Sequence
  No.280  HC variable region
EVQLVESGGGLVQPGGSLRLSCAASGITVSSNYMSWVRQAPGKGLEWVSVIYSGGSTNYADSVKGRFTISRDNSKNTLYLQMNSLRAEDTAVYYCARDLIVYGMDVWGQGTTVTVSS

SEQ ID NO: 2301 - protein, 111 aa, Artificial Sequence
  No.281  LC variable region
ELVLTQPPSVSGAPGQRVTISCTGSSSNIGAGYDVHWYQQLPGTAPKLLIYGNSNRPSGVPDRFSGSKSGTSASLAITGLQAEDEADYYCAAWDDSLSGWVFGGGTKVTVL

SEQ ID NO: 2302 - protein, 117 aa, Artificial Sequence
  No.281  HC variable region
QVQLVQSGGGLVQPGGSLRLSCAASGITVSSNYMSWVRQAPGKGLEWVSVIYSGGSTNYADSVKGRFTISRDNSKNTLYLQMNSLRAEDTAVYYCARDLIVYGMDVWGQGTTVTVSS

SEQ ID NO: 2303 - protein, 111 aa, Artificial Sequence
  No.282  LC variable region
ELVLTQPPSASGTPGQRVTISCSGSSSNIGAGYDVHWYQQLPGTAPKLLIYGNSNRPSGVPDRFSGSKSGTSASLAISGLQSEDEADYYCAAWDDSLNGGVFGGGTKVTVL

SEQ ID NO: 2304 - protein, 117 aa, Artificial Sequence; identical to SEQ ID NO: 2300
  No.282  HC variable region

SEQ ID NO: 2305 - protein, 108 aa, Artificial Sequence
  No.283  LC variable region
ELVMTQSPATLSLSPGERATLSCRASQSVSSYLAWYQQKPGQAPRLLIYDASNRATGIPARFSGSGSGTDFTLTISRLEPEDFAVYYCQQYGSSPPYTFGQGTKVDIK

SEQ ID NO: 2306 - protein, 116 aa, Artificial Sequence
  No.283  HC variable region
EVQLLESGGGLVQPGGSLRLSCAASGFTVSSNYMSWVRQAPGKGLEWVSVIYPGGSTYYADSVKGRFTISRDNSKNTLYLQMNSLRAEDTAVYYCARDLRGVLDYWGQGTLVTVSS

SEQ ID NO: 2307 - protein, 110 aa, Artificial Sequence; identical to SEQ ID NO: 1949
  No.284  LC variable region

SEQ ID NO: 2308 - protein, 119 aa, Artificial Sequence
  No.284  HC variable region
QVQLVQSGGGLVQPGGSLRLSCAASGVTVSSNYMSWVRQAPGKGLEWVSVIYSGGSTYYADSVKGRFTISRHNSKNTLYLQMNSLRAEDTAVYYCARGHVDIPYGMDVWGQGTTVTVSS

SEQ ID NO: 2309 - protein, 111 aa, Artificial Sequence
  No.285  LC variable region
ELELTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKVTVL

SEQ ID NO: 2310 - protein, 124 aa, Artificial Sequence
  No.285  HC variable region
EVQLVQSGAEVKKPGSSVKVSCKASGGTFSSYAISWVRQAPGQGLEWMGRIIPILGIANYAQKFQGRVTITADKSTSTAYMELSSLRSEDTAVYYCAREKGYSGSGSVNWFDPWGQGTLVTVSS

SEQ ID NO: 2311 - protein, 111 aa, Artificial Sequence; identical to SEQ ID NO: 2131
  No.286  LC variable region

SEQ ID NO: 2312 - protein, 124 aa, Artificial Sequence
  No.286  HC variable region
QVQLVQSGAEVKKPGSSVKVSCKASGGTFSSYAISWVRQAPGQGLEWMGRIIPILGIANYAQKFQGRVTITADKSTSTAYMELSSLRSEDTAVYYCAREKGYSGSGSVNWFDPWGQGTLVTVPS

SEQ ID NO: 2313 - protein, 111 aa, Artificial Sequence
  No.287  LC variable region
ELVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTQLTVL

SEQ ID NO: 2314 - protein, 123 aa, Artificial Sequence; identical to SEQ ID NO: 2240
  No.287  HC variable region

SEQ ID NO: 2315 - protein, 111 aa, Artificial Sequence
  No.288  LC variable region
ELMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNHWVFGGGTKVTVL

SEQ ID NO: 2316 - protein, 125 aa, Artificial Sequence
  No.288  HC variable region
QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARANLGYCTNGVCAPSGGWGQGTLVTVSS

SEQ ID NO: 2317 - protein, 110 aa, Artificial Sequence
  No.289  LC variable region
ELVLTQPPSVSAAPGQKVTISCSGGSSNIGNNYVSWYQQLPGTAPKLLIYDNNKRPSGIPDRFSGSKSGTSATLGITGLQTGDEADYYCGTWDSSLSAWVFGGGTKLTVL

SEQ ID NO: 2318 - protein, 125 aa, Artificial Sequence
  No.289  HC variable region
EVQLLESGGGLVQPGRSLRLSCAASGFTFGDYAMHWVRQAPGKGLEWVSGISWNSGRIGYADSVKGRFTISRDNAKNSLYLQMNSLRAEDTALYYCAKNLRYFDWLLGDDAFDIWGQGTMVTVSS

SEQ ID NO: 2319 - protein, 111 aa, Artificial Sequence; identical to SEQ ID NO: 2141
  No.290  LC variable region

SEQ ID NO: 2320 - protein, 117 aa, Artificial Sequence
  No.290  HC variable region
EVQLVQSGGGLVQPGGSLRLSCAASGFTVSSNYMTWVRQAPGKGLEWVSVIYSGGSTFYADSVKGRFTISRDNSKNTLYLQMNSLRAEDTAVYYCARDLVVYGMDVWGQGTTVTVSS

SEQ ID NO: 2321 - protein, 1273 aa, Artificial Sequence
  SARS-CoV-2 Spike protein
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 2322 - protein, 218 aa, Artificial Sequence
  RBD(Receptor binding domain) of SARS-CoV-2 Spike protein
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKN

The invention claimed is:

1. A neutralizing binding molecule, which binds to a spike protein on a surface of SARS-COV-2, wherein the binding molecule is any one selected from the group consisting of binding molecules 1) to 106) below:

1) a binding molecule comprising a) a light-chain variable region comprising a CDR1 region of SEQ ID NO: 829, a CDR2 region of SEQ ID NO: 830, and a CDR3 region of SEQ ID NO: 831, and b) a heavy-chain variable region comprising a CDR1 region of SEQ ID NO: 832, a CDR2 region of SEQ ID NO: 833, and a CDR3 region of SEQ ID NO: 834;
2) a binding molecule comprising a) a light-chain variable region comprising a CDR1 region of SEQ ID NO: 1, a CDR2 region of SEQ ID NO: 2, and a CDR3 region of SEQ ID NO: 3, and b) a heavy-chain variable region comprising a CDR1 region of SEQ ID NO: 4, a CDR2 region of SEQ ID NO: 5, and a CDR3 region of SEQ ID NO: 6;
3) a binding molecule comprising a) a light-chain variable region comprising a CDR1 region of SEQ ID NO: 7, a CDR2 region of SEQ ID NO: 8, and a CDR3 region of SEQ ID NO: 9, and b) a heavy-chain variable region comprising a CDR1 region of SEQ ID NO: 10, a CDR2 region of SEQ ID NO: 11, and a CDR3 region of SEQ ID NO: 12;
4) a binding molecule comprising a) a light-chain variable region comprising a CDR1 region of SEQ ID NO: 13, a CDR2 region of SEQ ID NO: 14, and a CDR3 region of SEQ ID NO: 15, and b) a heavy-chain variable region comprising a CDR1 region of SEQ ID NO: 16, a CDR2 region of SEQ ID NO: 17, and a CDR3 region of SEQ ID NO: 18;
5) a binding molecule comprising a) a light-chain variable region comprising a CDR1 region of SEQ ID NO: 19, a CDR2 region of SEQ ID NO: 20, and a CDR3 region of SEQ ID NO: 21, and b) a heavy-chain variable region comprising a CDR1 region of SEQ ID NO: 22, a CDR2 region of SEQ ID NO: 23, and a CDR3 region of SEQ ID NO: 24;
6) a binding molecule comprising a) a light-chain variable region comprising a CDR1 region of SEQ ID NO: 31, a CDR2 region of SEQ ID NO: 32, and a CDR3 region of SEQ ID NO: 33, and b) a heavy-chain variable region comprising a CDR1 region of SEQ ID NO: 34, a CDR2 region of SEQ ID NO: 35, and a CDR3 region of SEQ ID NO: 36;
7) a binding molecule comprising a) a light-chain variable region comprising a CDR1 region of SEQ ID NO: 37, a CDR2 region of SEQ ID NO: 38, and a CDR3 region of SEQ ID NO: 39, and b) a heavy-chain variable region comprising a CDR1 region of SEQ ID NO: 40, a CDR2 region of SEQ ID NO: 41, and a CDR3 region of SEQ ID NO: 42;
8) a binding molecule comprising a) a light-chain variable region comprising a CDR1 region of SEQ ID NO: 43, a CDR2 region of SEQ ID NO: 44, and a CDR3 region of SEQ ID NO: 45, and b) a heavy-chain variable region comprising a CDR1 region of SEQ ID NO: 46, a CDR2 region of SEQ ID NO: 47, and a CDR3 region of SEQ ID NO: 48;
9) a binding molecule comprising a) a light-chain variable region comprising a CDR1 region of SEQ ID NO: 49, a CDR2 region of SEQ ID NO: 50, and a CDR3 region of SEQ ID NO: 51, and b) a heavy-chain variable region comprising a CDR1 region of SEQ ID NO: 52, a CDR2 region of SEQ ID NO: 53, and a CDR3 region of SEQ ID NO: 54;
10) a binding molecule comprising a) a light-chain variable region comprising a CDR1 region of SEQ ID NO: 73, a CDR2 region of SEQ ID NO: 74, and a CDR3 region of SEQ ID NO: 75, and b) a heavy-chain variable region comprising a CDR1 region of SEQ ID NO: 76, a CDR2 region of SEQ ID NO: 77, and a CDR3 region of SEQ ID NO: 78;
11) a binding molecule comprising a) a light-chain variable region comprising a CDR1 region of SEQ ID NO: 79, a CDR2 region of SEQ ID NO: 80, and a CDR3 region of SEQ ID NO: 81, and b) a heavy-chain variable region comprising a CDR1 region of SEQ ID NO: 82, a CDR2 region of SEQ ID NO: 83, and a CDR3 region of SEQ ID NO: 84;
12) a binding molecule comprising a) a light-chain variable region comprising a CDR1 region of SEQ ID NO: 181, a CDR2 region of SEQ ID NO: 182, and a CDR3 region of SEQ ID NO: 183, and b) a heavy-chain variable region comprising a CDR1 region of SEQ ID NO: 184, a CDR2 region of SEQ ID NO: 185, and a CDR3 region of SEQ ID NO: 186;
13) a binding molecule comprising a) a light-chain variable region comprising a CDR1 region of SEQ ID NO: 259, a CDR2 region of SEQ ID NO: 260, and a CDR3 region of SEQ ID NO: 261, and b) a heavy-chain variable region comprising a CDR1 region of SEQ ID NO: 262, a CDR2 region of SEQ ID NO: 263, and a CDR3 region of SEQ ID NO: 264;
14) a binding molecule comprising a) a light-chain variable region comprising a CDR1 region of SEQ ID NO: 271, a CDR2 region of SEQ ID NO: 272, and a CDR3 region of SEQ ID NO: 273, and b) a heavy-chain variable region comprising a CDR1 region of SEQ ID NO: 274, a CDR2 region of SEQ ID NO: 275, and a CDR3 region of SEQ ID NO: 276;
15) a binding molecule comprising a) a light-chain variable region comprising a CDR1 region of SEQ ID NO: 277, a CDR2 region of SEQ ID NO: 278, and a CDR3 region of SEQ ID NO: 279, and b) a heavy-chain variable region comprising a CDR1 region of SEQ ID NO: 280, a CDR2 region of SEQ ID NO: 281, and a CDR3 region of SEQ ID NO: 282;
16) a binding molecule comprising a) a light-chain variable region comprising a CDR1 region of SEQ ID NO: 283, a CDR2 region of SEQ ID NO: 284, and a CDR3 region of SEQ ID NO: 285, and b) a heavy-chain variable region comprising a CDR1 region of SEQ ID NO: 286, a CDR2 region of SEQ ID NO: 287, and a CDR3 region of SEQ ID NO: 288;
17) a binding molecule comprising a) a light-chain variable region comprising a CDR1 region of SEQ ID NO: 289, a CDR2 region of SEQ ID NO: 290, and a CDR3 region of SEQ ID NO: 291, and b) a heavy-chain variable region comprising a CDR1 region of SEQ ID NO: 292, a CDR2 region of SEQ ID NO: 293, and a CDR3 region of SEQ ID NO: 294;
18) a binding molecule comprising a) a light-chain variable region comprising a CDR1 region of SEQ ID NO: 313, a CDR2 region of SEQ ID NO: 314, and a CDR3 region of SEQ ID NO: 315, and b) a heavy-chain variable region comprising a CDR1 region of SEQ ID NO: 316, a CDR2 region of SEQ ID NO: 317, and a CDR3 region of SEQ ID NO: 318;
19) a binding molecule comprising a) a light-chain variable region comprising a CDR1 region of SEQ ID NO: 325, a CDR2 region of SEQ ID NO: 326, and a CDR3 region of SEQ ID NO: 327, and b) a heavy-chain variable region comprising a CDR1 region of SEQ ID NO: 328, a CDR2 region of SEQ ID NO: 329, and a CDR3 region of SEQ ID NO: 330;
20) a binding molecule comprising a) a light-chain variable region comprising a CDR1 region of SEQ ID NO: 331, a CDR2 region of SEQ ID NO: 332, and a CDR3 region of SEQ ID NO: 333, and b) a heavy-chain variable region comprising a CDR1 region of SEQ ID NO: 334, a CDR2 region of SEQ ID NO: 335, and a CDR3 region of SEQ ID NO: 336;
21) a binding molecule comprising a) a light-chain variable region comprising a CDR1 region of SEQ ID NO: 385, a CDR2 region of SEQ ID NO: 386, and a CDR3 region of SEQ ID NO: 387, and b) a heavy-chain variable region comprising a CDR1 region of SEQ ID NO: 388, a CDR2 region of SEQ ID NO: 389, and a CDR3 region of SEQ ID NO: 390;
22) a binding molecule comprising a) a light-chain variable region comprising a CDR1 region of SEQ ID NO: 391, a CDR2 region of SEQ ID NO: 392, and a CDR3 region of SEQ ID NO: 393, and b) a heavy-chain variable region comprising a CDR1 region of SEQ ID NO: 394, a CDR2 region of SEQ ID NO: 395, and a CDR3 region of SEQ ID NO: 396;
23) a binding molecule comprising a) a light-chain variable region comprising a CDR1 region of SEQ ID NO: 409, a CDR2 region of SEQ ID NO: 410, and a CDR3 region of SEQ ID NO: 411, and b) a heavy-chain variable region comprising a CDR1 region of SEQ ID NO: 412, a CDR2 region of SEQ ID NO: 413, and a CDR3 region of SEQ ID NO: 414;
24) a binding molecule comprising a) a light-chain variable region comprising a CDR1 region of SEQ ID NO: 415, a CDR2 region of SEQ ID NO: 416, and a CDR3 region of SEQ ID NO: 417, and b) a heavy-chain variable region comprising a CDR1 region of SEQ ID NO: 418, a CDR2 region of SEQ ID NO: 419, and a CDR3 region of SEQ ID NO: 420;
25) a binding molecule comprising a) a light-chain variable region comprising a CDR1 region of SEQ ID NO: 421, a CDR2 region of SEQ ID NO: 422, and a CDR3 region of SEQ ID NO: 423, and b) a heavy-chain variable region comprising a CDR1 region of SEQ ID NO: 424, a CDR2 region of SEQ ID NO: 425, and a CDR3 region of SEQ ID NO: 426;
26) a binding molecule comprising a) a light-chain variable region comprising a CDR1 region of SEQ ID NO: 427, a CDR2 region of SEQ ID NO: 428, and a CDR3 region of SEQ ID NO: 429, and b) a heavy-chain variable region comprising a CDR1 region of SEQ ID NO: 430, a CDR2 region of SEQ ID NO: 431, and a CDR3 region of SEQ ID NO: 432;
27) a binding molecule comprising a) a light-chain variable region comprising a CDR1 region of SEQ ID NO: 469, a CDR2 region of SEQ ID NO: 470, and a CDR3 region of SEQ ID NO: 471, and b) a heavy-chain variable region comprising a CDR1 region of SEQ ID NO: 472, a CDR2 region of SEQ ID NO: 473, and a CDR3 region of SEQ ID NO: 474;
28) a binding molecule comprising a) a light-chain variable region comprising a CDR1 region of SEQ ID NO: 481, a CDR2 region of SEQ ID NO: 482, and a CDR3 region of SEQ ID NO: 483, and b) a heavy-chain variable region comprising a CDR1 region of SEQ ID NO: 484, a CDR2 region of SEQ ID NO: 485, and a CDR3 region of SEQ ID NO: 486;
29) a binding molecule comprising a) a light-chain variable region comprising a CDR1 region of SEQ ID NO: 493, a CDR2 region of SEQ ID NO: 494, and a CDR3 region of SEQ ID NO: 495, and b) a heavy-chain variable region comprising a CDR1 region of SEQ ID NO: 496, a CDR2 region of SEQ ID NO: 497, and a CDR3 region of SEQ ID NO: 498;
30) a binding molecule comprising a) a light-chain variable region comprising a CDR1 region of SEQ ID NO: 511, a CDR2 region of SEQ ID NO: 512, and a CDR3 region of SEQ ID NO: 513, and b) a heavy-chain variable region comprising a CDR1 region of SEQ ID NO: 514, a CDR2 region of SEQ ID NO: 515, and a CDR3 region of SEQ ID NO: 516;
31) a binding molecule comprising a) a light-chain variable region comprising a CDR1 region of SEQ ID NO: 523, a CDR2 region of SEQ ID NO: 524, and a CDR3 region of SEQ ID NO: 525, and b) a heavy-chain variable region comprising a CDR1 region of SEQ ID NO: 526, a CDR2 region of SEQ ID NO: 527, and a CDR3 region of SEQ ID NO: 528;
32) a binding molecule comprising a) a light-chain variable region comprising a CDR1 region of SEQ ID NO: 529, a CDR2 region of SEQ ID NO: 530, and a CDR3 region of SEQ ID NO: 531, and b) a heavy-chain variable region comprising a CDR1 region of SEQ ID NO: 532, a CDR2 region of SEQ ID NO: 533, and a CDR3 region of SEQ ID NO: 534;
33) a binding molecule comprising a) a light-chain variable region comprising a CDR1 region of SEQ ID NO: 535, a CDR2 region of SEQ ID NO: 536, and a CDR3 region of SEQ ID NO: 537, and b) a heavy-chain variable region comprising a CDR1 region of SEQ ID NO: 538, a CDR2 region of SEQ ID NO: 539, and a CDR3 region of SEQ ID NO: 540;
34) a binding molecule comprising a) a light-chain variable region comprising a CDR1 region of SEQ ID NO: 541, a CDR2 region of SEQ ID NO: 542, and a CDR3 region of SEQ ID NO: 543, and b) a heavy-chain variable region comprising a CDR1 region of SEQ ID NO: 544, a CDR2 region of SEQ ID NO: 545, and a CDR3 region of SEQ ID NO: 546;
35) a binding molecule comprising a) a light-chain variable region comprising a CDR1 region of SEQ ID NO: 553, a CDR2 region of SEQ ID NO: 554, and a CDR3 region of SEQ ID NO: 555, and b) a heavy-chain variable region comprising a CDR1 region of SEQ ID NO: 556, a CDR2 region of SEQ ID NO: 557, and a CDR3 region of SEQ ID NO: 558;
36) a binding molecule comprising a) a light-chain variable region comprising a CDR1 region of SEQ ID NO: 565, a CDR2 region of SEQ ID NO: 566, and a CDR3 region of SEQ ID NO: 567, and b) a heavy-chain variable region comprising a CDR1 region of SEQ ID NO: 568, a CDR2 region of SEQ ID NO: 569, and a CDR3 region of SEQ ID NO: 570;
37) a binding molecule comprising a) a light-chain variable region comprising a CDR1 region of SEQ ID NO: 613, a CDR2 region of SEQ ID NO: 614, and a CDR3 region of SEQ ID NO: 615, and b) a heavy-chain variable region comprising a CDR1 region of SEQ ID NO: 616, a CDR2 region of SEQ ID NO: 617, and a CDR3 region of SEQ ID NO: 618;
38) a binding molecule comprising a) a light-chain variable region comprising a CDR1 region of SEQ ID NO: 643, a CDR2 region of SEQ ID NO: 644, and a CDR3 region of SEQ ID NO: 645, and b) a heavy-chain variable region comprising a CDR1 region of SEQ ID NO: 646, a CDR2 region of SEQ ID NO: 647, and a CDR3 region of SEQ ID NO: 648;
39) a binding molecule comprising a) a light-chain variable region comprising a CDR1 region of SEQ ID NO: 673, a CDR2 region of SEQ ID NO: 674, and a CDR3 region of SEQ ID NO: 675, and b) a heavy-chain variable region comprising a CDR1 region of SEQ ID NO: 676, a CDR2 region of SEQ ID NO: 677, and a CDR3 region of SEQ ID NO: 678;
40) a binding molecule comprising a) a light-chain variable region comprising a CDR1 region of SEQ ID NO: 703, a CDR2 region of SEQ ID NO: 704, and a CDR3 region of SEQ ID NO: 705, and b) a heavy-chain variable region comprising a CDR1 region of SEQ ID NO: 706, a CDR2 region of SEQ ID NO: 707, and a CDR3 region of SEQ ID NO: 708;
41) a binding molecule comprising a) a light-chain variable region comprising a CDR1 region of SEQ ID NO: 763, a CDR2 region of SEQ ID NO: 764, and a CDR3 region of SEQ ID NO: 765, and b) a heavy-chain variable region comprising a CDR1 region of SEQ ID NO: 766, a CDR2 region of SEQ ID NO: 767, and a CDR3 region of SEQ ID NO: 768;
42) a binding molecule comprising a) a light-chain variable region comprising a CDR1 region of SEQ ID NO: 769, a CDR2 region of SEQ ID NO: 770, and a CDR3 region of SEQ ID NO: 771, and b) a heavy-chain variable region comprising a CDR1 region of SEQ ID NO: 772, a CDR2 region of SEQ ID NO: 773, and a CDR3 region of SEQ ID NO: 774;
43) a binding molecule comprising a) a light-chain variable region comprising a CDR1 region of SEQ ID NO: 907, a CDR2 region of SEQ ID NO: 908, and a CDR3 region of SEQ ID NO: 909, and b) a heavy-chain variable region comprising a CDR1 region of SEQ ID NO: 910, a CDR2 region of SEQ ID NO: 911, and a CDR3 region of SEQ ID NO: 912;
44) a binding molecule comprising a) a light-chain variable region comprising a CDR1 region of SEQ ID NO: 1165, a CDR2 region of SEQ ID NO: 1166, and a CDR3 region of SEQ ID NO: 1167, and b) a heavy-chain variable region comprising a CDR1 region of SEQ ID NO: 1168, a CDR2 region of SEQ ID NO: 1169, and a CDR3 region of SEQ ID NO: 1170;
45) a binding molecule comprising a) a light-chain variable region comprising a CDR1 region of SEQ ID NO: 1171, a CDR2 region of SEQ ID NO: 1172, and a CDR3 region of SEQ ID NO: 1173, and b) a heavy-chain variable region comprising a CDR1 region of SEQ ID NO: 1174, a CDR2 region of SEQ ID NO: 1175, and a CDR3 region of SEQ ID NO: 1176;
46) a binding molecule comprising a) a light-chain variable region comprising a CDR1 region of SEQ ID NO: 1177, a CDR2 region of SEQ ID NO: 1178, and a CDR3 region of SEQ ID NO: 1179, and b) a heavy-chain variable region comprising a CDR1 region of SEQ ID NO: 1180, a CDR2 region of SEQ ID NO: 1181, and a CDR3 region of SEQ ID NO: 1182;
47) a binding molecule comprising a) a light-chain variable region comprising a CDR1 region of SEQ ID NO: 1201, a CDR2 region of SEQ ID NO: 1202, and a CDR3 region of SEQ ID NO: 1203, and b) a heavy-chain variable region comprising a CDR1 region of SEQ ID NO: 1204, a CDR2 region of SEQ ID NO: 1205, and a CDR3 region of SEQ ID NO: 1206;
48) a binding molecule comprising a) a light-chain variable region comprising a CDR1 region of SEQ ID NO: 1213, a CDR2 region of SEQ ID NO: 1214, and a CDR3 region of SEQ ID NO: 1215, and b) a heavy-chain variable region comprising a CDR1 region of SEQ ID NO: 1216, a CDR2 region of SEQ ID NO: 1217, and a CDR3 region of SEQ ID NO: 1218;
49) a binding molecule comprising a) a light-chain variable region comprising a CDR1 region of SEQ ID NO: 1219, a CDR2 region of SEQ ID NO: 1220, and a CDR3 region of SEQ ID NO: 1221, and b) a heavy-chain variable region comprising a CDR1 region of SEQ ID NO: 1222, a CDR2 region of SEQ ID NO: 1223, and a CDR3 region of SEQ ID NO: 1224;
50) a binding molecule comprising a) a light-chain variable region comprising a CDR1 region of SEQ ID NO: 1225, a CDR2 region of SEQ ID NO: 1226, and a CDR3 region of SEQ ID NO: 1227, and b) a heavy-chain variable region comprising a CDR1 region of SEQ ID NO: 1228, a CDR2 region of SEQ ID NO: 1229, and a CDR3 region of SEQ ID NO: 1230;
51) a binding molecule comprising a) a light-chain variable region comprising a CDR1 region of SEQ ID NO: 1231, a CDR2 region of SEQ ID NO: 1232, and a CDR3 region of SEQ ID NO: 1233, and b) a heavy-chain variable region comprising a CDR1 region of SEQ ID NO: 1234, a CDR2 region of SEQ ID NO: 1235, and a CDR3 region of SEQ ID NO: 1236;
52) a binding molecule comprising a) a light-chain variable region comprising a CDR1 region of SEQ ID NO: 1237, a CDR2 region of SEQ ID NO: 1238, and a CDR3 region of SEQ ID NO: 1239, and b) a heavy-chain variable region comprising a CDR1 region of SEQ ID NO: 1240, a CDR2 region of SEQ ID NO: 1241, and a CDR3 region of SEQ ID NO: 1242;
53) a binding molecule comprising a) a light-chain variable region comprising a CDR1 region of SEQ ID NO: 1243, a CDR2 region of SEQ ID NO: 1244, and a CDR3 region of SEQ ID NO: 1245, and b) a heavy-chain variable region comprising a CDR1 region of SEQ ID NO: 1246, a CDR2 region of SEQ ID NO: 1247, and a CDR3 region of SEQ ID NO: 1248;
54) a binding molecule comprising a) a light-chain variable region comprising a CDR1 region of SEQ ID NO: 1249, a CDR2 region of SEQ ID NO: 1250, and a CDR3 region of SEQ ID NO: 1251, and b) a heavy-chain variable region comprising a CDR1 region of SEQ ID NO: 1252, a CDR2 region of SEQ ID NO: 1253, and a CDR3 region of SEQ ID NO: 1254;
55) a binding molecule comprising a) a light-chain variable region comprising a CDR1 region of SEQ ID NO: 1267, a CDR2 region of SEQ ID NO: 1268, and a CDR3 region of SEQ ID NO: 1269, and b) a heavy-chain variable region comprising a CDR1 region of SEQ ID NO: 1270, a CDR2 region of SEQ ID NO: 1271, and a CDR3 region of SEQ ID NO: 1272;
56) a binding molecule comprising a) a light-chain variable region comprising a CDR1 region of SEQ ID NO: 1273, a CDR2 region of SEQ ID NO: 1274, and a CDR3 region of SEQ ID NO: 1275, and b) a heavy-chain variable region comprising a CDR1 region of SEQ ID NO: 1276, a CDR2 region of SEQ ID NO: 1277, and a CDR3 region of SEQ ID NO: 1278;
57) a binding molecule comprising a) a light-chain variable region comprising a CDR1 region of SEQ ID NO: 1279, a CDR2 region of SEQ ID NO: 1280, and a CDR3 region of SEQ ID NO: 1281, and b) a heavy-chain variable region comprising a CDR1 region of SEQ ID NO: 1282, a CDR2 region of SEQ ID NO: 1283, and a CDR3 region of SEQ ID NO: 1284;
58) a binding molecule comprising a) a light-chain variable region comprising a CDR1 region of SEQ ID NO: 1285, a CDR2 region of SEQ ID NO: 1286, and a CDR3 region of SEQ ID NO: 1287, and b) a heavy-chain variable region comprising a CDR1 region of SEQ ID NO: 1288, a CDR2 region of SEQ ID NO: 1289, and a CDR3 region of SEQ ID NO: 1290;
59) a binding molecule comprising a) a light-chain variable region comprising a CDR1 region of SEQ ID NO: 1291, a CDR2 region of SEQ ID NO: 1292, and a CDR3 region of SEQ ID NO: 1293, and b) a heavy-chain variable region comprising a CDR1 region of SEQ ID NO: 1294, a CDR2 region of SEQ ID NO: 1295, and a CDR3 region of SEQ ID NO: 1296;
60) a binding molecule comprising a) a light-chain variable region comprising a CDR1 region of SEQ ID NO: 1297, a CDR2 region of SEQ ID NO: 1298, and a CDR3 region of SEQ ID NO: 1299, and b) a heavy-chain variable region comprising a CDR1 region of SEQ ID NO: 1300, a CDR2 region of SEQ ID NO: 1301, and a CDR3 region of SEQ ID NO: 1302;
61) a binding molecule comprising a) a light-chain variable region comprising a CDR1 region of SEQ ID NO: 1303, a CDR2 region of SEQ ID NO: 1304, and a CDR3 region of SEQ ID NO: 1305, and b) a heavy-chain variable region comprising a CDR1 region of SEQ ID NO: 1306, a CDR2 region of SEQ ID NO: 1307, and a CDR3 region of SEQ ID NO: 1308;
62) a binding molecule comprising a) a light-chain variable region comprising a CDR1 region of SEQ ID NO: 1309, a CDR2 region of SEQ ID NO: 1310, and a CDR3 region of SEQ ID NO: 1311, and b) a heavy-chain variable region comprising a CDR1 region of SEQ ID NO: 1312, a CDR2 region of SEQ ID NO: 1313, and a CDR3 region of SEQ ID NO: 1314;
63) a binding molecule comprising a) a light-chain variable region comprising a CDR1 region of SEQ ID NO: 1315, a CDR2 region of SEQ ID NO: 1316, and a CDR3 region of SEQ ID NO: 1317, and b) a heavy-chain variable region comprising a CDR1 region of SEQ ID NO: 1318, a CDR2 region of SEQ ID NO: 1319, and a CDR3 region of SEQ ID NO: 1320;
64) a binding molecule comprising a) a light-chain variable region comprising a CDR1 region of SEQ ID NO: 1321, a CDR2 region of SEQ ID NO: 1322, and a CDR3 region of SEQ ID NO: 1323, and b) a heavy-chain variable region comprising a CDR1 region of SEQ ID NO: 1324, a CDR2 region of SEQ ID NO: 1325, and a CDR3 region of SEQ ID NO: 1326;
65) a binding molecule comprising a) a light-chain variable region comprising a CDR1 region of SEQ ID NO: 1339, a CDR2 region of SEQ ID NO: 1340, and a CDR3 region of SEQ ID NO: 1341, and b) a heavy-chain variable region comprising a CDR1 region of SEQ ID NO: 1342, a CDR2 region of SEQ ID NO: 1343, and a CDR3 region of SEQ ID NO: 1344;
66) a binding molecule comprising a) a light-chain variable region comprising a CDR1 region of SEQ ID NO: 1375, a CDR2 region of SEQ ID NO: 1376, and a CDR3 region of SEQ ID NO: 1377, and b) a heavy-chain variable region comprising a CDR1 region of SEQ ID NO: 1378, a CDR2 region of SEQ ID NO: 1379, and a CDR3 region of SEQ ID NO: 1380;
67) a binding molecule comprising a) a light-chain variable region comprising a CDR1 region of SEQ ID NO: 1387, a CDR2 region of SEQ ID NO: 1388, and a CDR3 region of SEQ ID NO: 1389, and b) a heavy-chain variable region comprising a CDR1 region of SEQ ID NO: 1390, a CDR2 region of SEQ ID NO: 1391, and a CDR3 region of SEQ ID NO: 1392;
68) a binding molecule comprising a) a light-chain variable region comprising a CDR1 region of SEQ ID NO: 1405, a CDR2 region of SEQ ID NO: 1406, and a CDR3 region of SEQ ID NO: 1407, and b) a heavy-chain variable region comprising a CDR1 region of SEQ ID NO: 1408, a CDR2 region of SEQ ID NO: 1409, and a CDR3 region of SEQ ID NO: 1410;
69) a binding molecule comprising a) a light-chain variable region comprising a CDR1 region of SEQ ID NO: 1411, a CDR2 region of SEQ ID NO: 1412, and a CDR3 region of SEQ ID NO: 1413, and b) a heavy-chain variable region comprising a CDR1 region of SEQ ID NO: 1414, a CDR2 region of SEQ ID NO: 1415, and a CDR3 region of SEQ ID NO: 1416;
70) a binding molecule comprising a) a light-chain variable region comprising a CDR1 region of SEQ ID NO: 1429, a CDR2 region of SEQ ID NO: 1430, and a CDR3 region of SEQ ID NO: 1431, and b) a heavy-chain variable region comprising a CDR1 region of SEQ ID NO: 1432, a CDR2 region of SEQ ID NO: 1433, and a CDR3 region of SEQ ID NO: 1434;
71) a binding molecule comprising a) a light-chain variable region comprising a CDR1 region of SEQ ID NO: 1441, a CDR2 region of SEQ ID NO: 1442, and a CDR3 region of SEQ ID NO: 1443, and b) a heavy-chain variable region comprising a CDR1 region of SEQ ID NO: 1444, a CDR2 region of SEQ ID NO: 1445, and a CDR3 region of SEQ ID NO: 1446;
72) a binding molecule comprising a) a light-chain variable region comprising a CDR1 region of SEQ ID NO: 1447, a CDR2 region of SEQ ID NO: 1448, and a CDR3 region of SEQ ID NO: 1449, and b) a heavy-chain variable region comprising a CDR1 region of SEQ ID NO: 1450, a CDR2 region of SEQ ID NO: 1451, and a CDR3 region of SEQ ID NO: 1452;

73) a binding molecule comprising a) a light-chain variable region comprising a CDR1 region of SEQ ID NO: 1453, a CDR2 region of SEQ ID NO: 1454, and a CDR3 region of SEQ ID NO: 1455, and b) a heavy-chain variable region comprising a CDR1 region of SEQ ID NO: 1456, a CDR2 region of SEQ ID NO: 1457, and a CDR3 region of SEQ ID NO: 1458;

74) a binding molecule comprising a) a light-chain variable region comprising a CDR1 region of SEQ ID NO: 1459, a CDR2 region of SEQ ID NO: 1460, and a CDR3 region of SEQ ID NO: 1461, and b) a heavy-chain variable region comprising a CDR1 region of SEQ ID NO: 1462, a CDR2 region of SEQ ID NO: 1463, and a CDR3 region of SEQ ID NO: 1464;

75) a binding molecule comprising a) a light-chain variable region comprising a CDR1 region of SEQ ID NO: 1465, a CDR2 region of SEQ ID NO: 1466, and a CDR3 region of SEQ ID NO: 1467, and b) a heavy-chain variable region comprising a CDR1 region of SEQ ID NO: 1468, a CDR2 region of SEQ ID NO: 1469, and a CDR3 region of SEQ ID NO: 1470;

76) a binding molecule comprising a) a light-chain variable region comprising a CDR1 region of SEQ ID NO: 1471, a CDR2 region of SEQ ID NO: 1472, and a CDR3 region of SEQ ID NO: 1473, and b) a heavy-chain variable region comprising a CDR1 region of SEQ ID NO: 1474, a CDR2 region of SEQ ID NO: 1475, and a CDR3 region of SEQ ID NO: 1476;

77) a binding molecule comprising a) a light-chain variable region comprising a CDR1 region of SEQ ID NO: 1477, a CDR2 region of SEQ ID NO: 1478, and a CDR3 region of SEQ ID NO: 1479, and b) a heavy-chain variable region comprising a CDR1 region of SEQ ID NO: 1480, a CDR2 region of SEQ ID NO: 1481, and a CDR3 region of SEQ ID NO: 1482;

78) a binding molecule comprising a) a light-chain variable region comprising a CDR1 region of SEQ ID NO: 1489, a CDR2 region of SEQ ID NO: 1490, and a CDR3 region of SEQ ID NO: 1491, and b) a heavy-chain variable region comprising a CDR1 region of SEQ ID NO: 1492, a CDR2 region of SEQ ID NO: 1493, and a CDR3 region of SEQ ID NO: 1494;

79) a binding molecule comprising a) a light-chain variable region comprising a CDR1 region of SEQ ID NO: 1495, a CDR2 region of SEQ ID NO: 1496, and a CDR3 region of SEQ ID NO: 1497, and b) a heavy-chain variable region comprising a CDR1 region of SEQ ID NO: 1498, a CDR2 region of SEQ ID NO: 1499, and a CDR3 region of SEQ ID NO: 1500;

80) a binding molecule comprising a) a light-chain variable region comprising a CDR1 region of SEQ ID NO: 1501, a CDR2 region of SEQ ID NO: 1502, and a CDR3 region of SEQ ID NO: 1503, and b) a heavy-chain variable region comprising a CDR1 region of SEQ ID NO: 1504, a CDR2 region of SEQ ID NO: 1505, and a CDR3 region of SEQ ID NO: 1506;

81) a binding molecule comprising a) a light-chain variable region comprising a CDR1 region of SEQ ID NO: 1507, a CDR2 region of SEQ ID NO: 1508, and a CDR3 region of SEQ ID NO: 1509, and b) a heavy-chain variable region comprising a CDR1 region of SEQ ID NO: 1510, a CDR2 region of SEQ ID NO: 1511, and a CDR3 region of SEQ ID NO: 1512;

82) a binding molecule comprising a) a light-chain variable region comprising a CDR1 region of SEQ ID NO: 1519, a CDR2 region of SEQ ID NO: 1520, and a CDR3 region of SEQ ID NO: 1521, and b) a heavy-chain variable region comprising a CDR1 region of SEQ ID NO: 1522, a CDR2 region of SEQ ID NO: 1523, and a CDR3 region of SEQ ID NO: 1524;

83) a binding molecule comprising a) a light-chain variable region comprising a CDR1 region of SEQ ID NO: 1531, a CDR2 region of SEQ ID NO: 1532, and a CDR3 region of SEQ ID NO: 1533, and b) a heavy-chain variable region comprising a CDR1 region of SEQ ID NO: 1534, a CDR2 region of SEQ ID NO: 1535, and a CDR3 region of SEQ ID NO: 1536;

84) a binding molecule comprising a) a light-chain variable region comprising a CDR1 region of SEQ ID NO: 1549, a CDR2 region of SEQ ID NO: 1550, and a CDR3 region of SEQ ID NO: 1551, and b) a heavy-chain variable region comprising a CDR1 region of SEQ ID NO: 1552, a CDR2 region of SEQ ID NO: 1553, and a CDR3 region of SEQ ID NO: 1554;

85) a binding molecule comprising a) a light-chain variable region comprising a CDR1 region of SEQ ID NO: 1555, a CDR2 region of SEQ ID NO: 1556, and a CDR3 region of SEQ ID NO: 1557, and b) a heavy-chain variable region comprising a CDR1 region of SEQ ID NO: 1558, a CDR2 region of SEQ ID NO: 1559, and a CDR3 region of SEQ ID NO: 1560;

86) a binding molecule comprising a) a light-chain variable region comprising a CDR1 region of SEQ ID NO: 1561, a CDR2 region of SEQ ID NO: 1562, and a CDR3 region of SEQ ID NO: 1563, and b) a heavy-chain variable region comprising a CDR1 region of SEQ ID NO: 1564, a CDR2 region of SEQ ID NO: 1565, and a CDR3 region of SEQ ID NO: 1566;

87) a binding molecule comprising a) a light-chain variable region comprising a CDR1 region of SEQ ID NO: 1573, a CDR2 region of SEQ ID NO: 1574, and a CDR3 region of SEQ ID NO: 1575, and b) a heavy-chain variable region comprising a CDR1 region of SEQ ID NO: 1576, a CDR2 region of SEQ ID NO: 1577, and a CDR3 region of SEQ ID NO: 1578;

88) a binding molecule comprising a) a light-chain variable region comprising a CDR1 region of SEQ ID NO: 1585, a CDR2 region of SEQ ID NO: 1586, and a CDR3 region of SEQ ID NO: 1587, and b) a heavy-chain variable region comprising a CDR1 region of SEQ ID NO: 1588, a CDR2 region of SEQ ID NO: 1589, and a CDR3 region of SEQ ID NO: 1590;

89) a binding molecule comprising a) a light-chain variable region comprising a CDR1 region of SEQ ID NO: 1591, a CDR2 region of SEQ ID NO: 1592, and a CDR3 region of SEQ ID NO: 1593, and b) a heavy-chain variable region comprising a CDR1 region of SEQ ID NO: 1594, a CDR2 region of SEQ ID NO: 1595, and a CDR3 region of SEQ ID NO: 1596;

90) a binding molecule comprising a) a light-chain variable region comprising a CDR1 region of SEQ ID NO: 1603, a CDR2 region of SEQ ID NO: 1604, and a CDR3 region of SEQ ID NO: 1605, and b) a heavy-chain variable region comprising a CDR1 region of SEQ ID NO: 1606, a CDR2 region of SEQ ID NO: 1607, and a CDR3 region of SEQ ID NO: 1608;

91) a binding molecule comprising a) a light-chain variable region comprising a CDR1 region of SEQ ID NO: 1615, a CDR2 region of SEQ ID NO: 1616, and a CDR3 region of SEQ ID NO: 1617, and b) a heavy-chain variable region comprising a CDR1 region of SEQ ID NO: 1618, a CDR2 region of SEQ ID NO: 1619, and a CDR3 region of SEQ ID NO: 1620;
92) a binding molecule comprising a) a light-chain variable region comprising a CDR1 region of SEQ ID NO: 1621, a CDR2 region of SEQ ID NO: 1622, and a CDR3 region of SEQ ID NO: 1623, and b) a heavy-chain variable region comprising a CDR1 region of SEQ ID NO: 1624, a CDR2 region of SEQ ID NO: 1625, and a CDR3 region of SEQ ID NO: 1626;
93) a binding molecule comprising a) a light-chain variable region comprising a CDR1 region of SEQ ID NO: 1639, a CDR2 region of SEQ ID NO: 1640, and a CDR3 region of SEQ ID NO: 1641, and b) a heavy-chain variable region comprising a CDR1 region of SEQ ID NO: 1642, a CDR2 region of SEQ ID NO: 1643, and a CDR3 region of SEQ ID NO: 1644;
94) a binding molecule comprising a) a light-chain variable region comprising a CDR1 region of SEQ ID NO: 1645, a CDR2 region of SEQ ID NO: 1646, and a CDR3 region of SEQ ID NO: 1647, and b) a heavy-chain variable region comprising a CDR1 region of SEQ ID NO: 1648, a CDR2 region of SEQ ID NO: 1649, and a CDR3 region of SEQ ID NO: 1650;
95) a binding molecule comprising a) a light-chain variable region comprising a CDR1 region of SEQ ID NO: 1651, a CDR2 region of SEQ ID NO: 1652, and a CDR3 region of SEQ ID NO: 1653, and b) a heavy-chain variable region comprising a CDR1 region of SEQ ID NO: 1654, a CDR2 region of SEQ ID NO: 1655, and a CDR3 region of SEQ ID NO: 1656;
96) a binding molecule comprising a) a light-chain variable region comprising a CDR1 region of SEQ ID NO: 1663, a CDR2 region of SEQ ID NO: 1664, and a CDR3 region of SEQ ID NO: 1665, and b) a heavy-chain variable region comprising a CDR1 region of SEQ ID NO: 1666, a CDR2 region of SEQ ID NO: 1667, and a CDR3 region of SEQ ID NO: 1668;
97) a binding molecule comprising a) a light-chain variable region comprising a CDR1 region of SEQ ID NO: 1669, a CDR2 region of SEQ ID NO: 1670, and a CDR3 region of SEQ ID NO: 1671, and b) a heavy-chain variable region comprising a CDR1 region of SEQ ID NO: 1672, a CDR2 region of SEQ ID NO: 1673, and a CDR3 region of SEQ ID NO: 1674;
98) a binding molecule comprising a) a light-chain variable region comprising a CDR1 region of SEQ ID NO: 1675, a CDR2 region of SEQ ID NO: 1676, and a CDR3 region of SEQ ID NO: 1677, and b) a heavy-chain variable region comprising a CDR1 region of SEQ ID NO: 1678, a CDR2 region of SEQ ID NO: 1679, and a CDR3 region of SEQ ID NO: 1680;
99) a binding molecule comprising a) a light-chain variable region comprising a CDR1 region of SEQ ID NO: 1681, a CDR2 region of SEQ ID NO: 1682, and a CDR3 region of SEQ ID NO: 1683, and b) a heavy-chain variable region comprising a CDR1 region of SEQ ID NO: 1684, a CDR2 region of SEQ ID NO: 1685, and a CDR3 region of SEQ ID NO: 1686;
100) a binding molecule comprising a) a light-chain variable region comprising a CDR1 region of SEQ ID NO: 1693, a CDR2 region of SEQ ID NO: 1694, and a CDR3 region of SEQ ID NO: 1695, and b) a heavy-chain variable region comprising a CDR1 region of SEQ ID NO: 1696, a CDR2 region of SEQ ID NO: 1697, and a CDR3 region of SEQ ID NO: 1698;
101) a binding molecule comprising a) a light-chain variable region comprising a CDR1 region of SEQ ID NO: 1699, a CDR2 region of SEQ ID NO: 1700, and a CDR3 region of SEQ ID NO: 1701, and b) a heavy-chain variable region comprising a CDR1 region of SEQ ID NO: 1702, a CDR2 region of SEQ ID NO: 1703, and a CDR3 region of SEQ ID NO: 1704;
102) a binding molecule comprising a) a light-chain variable region comprising a CDR1 region of SEQ ID NO: 1705, a CDR2 region of SEQ ID NO: 1706, and a CDR3 region of SEQ ID NO: 1707, and b) a heavy-chain variable region comprising a CDR1 region of SEQ ID NO: 1708, a CDR2 region of SEQ ID NO: 1709, and a CDR3 region of SEQ ID NO: 1710;
103) a binding molecule comprising a) a light-chain variable region comprising a CDR1 region of SEQ ID NO: 1717, a CDR2 region of SEQ ID NO: 1718, and a CDR3 region of SEQ ID NO: 1719, and b) a heavy-chain variable region comprising a CDR1 region of SEQ ID NO: 1720, a CDR2 region of SEQ ID NO: 1721, and a CDR3 region of SEQ ID NO: 1722;
104) a binding molecule comprising a) a light-chain variable region comprising a CDR1 region of SEQ ID NO: 1723, a CDR2 region of SEQ ID NO: 1724, and a CDR3 region of SEQ ID NO: 1725, and b) a heavy-chain variable region comprising a CDR1 region of SEQ ID NO: 1726, a CDR2 region of SEQ ID NO: 1727, and a CDR3 region of SEQ ID NO: 1728;
105) a binding molecule comprising a) a light-chain variable region comprising a CDR1 region of SEQ ID NO: 1729, a CDR2 region of SEQ ID NO: 1730, and a CDR3 region of SEQ ID NO: 1731, and b) a heavy-chain variable region comprising a CDR1 region of SEQ ID NO: 1732, a CDR2 region of SEQ ID NO: 1733, and a CDR3 region of SEQ ID NO: 1734; and
106) a binding molecule comprising a) a light-chain variable region comprising a CDR1 region of SEQ ID NO: 1735, a CDR2 region of SEQ ID NO: 1736, and a CDR3 region of SEQ ID NO: 1737, and b) a heavy-chain variable region comprising a CDR1 region of SEQ ID NO: 1738, a CDR2 region of SEQ ID NO: 1739, and a CDR3 region of SEQ ID NO: 1740.

2. The binding molecule of claim 1, wherein the binding molecule is an antibody or an antigen-binding fragment thereof.

3. The binding molecule of claim 2, wherein the antibody is a monoclonal antibody.

4. The binding molecule of claim 3, wherein the monoclonal antibody is a chimeric antibody, a humanized antibody, or a human antibody.

5. The binding molecule of claim 2, wherein the antigen-binding fragment is Fab, F(ab'), F(ab') 2, Fv, dAb, Fd, single-chain antibody fragment (scFv), scFv-Fc, bivalent single-chain antibody fragment, single-chain phage antibody fragment, diabody, triabody, or tetraabody.

6. The binding molecule of claim 1, wherein the binding molecule has neutralizing activity against a mutant virus having a mutation on the spike protein of SARS-CoV-2.

7. The binding molecule of claim 1, wherein the binding molecule has neutralizing activity against a mutant virus having a mutation on a site of the spike protein of SARS-COV-2 other than receptor-binding domain (RBD).

8. The binding molecule of claim 1, wherein the binding molecule has neutralizing activity against SARS-COV-2 S-type, L-type, V-type, G-type, GH-type or GR-type.

9. The binding molecule of claim 1, wherein the binding molecule has neutralizing activity against a mutant virus having a D614G mutation at amino acid position 614 of the spike protein of SARS-COV-2.

10. The binding molecule of claim 1, wherein the binding molecule does not cause an antibody-dependent enhancement (ADE) phenomenon.

\* \* \* \* \*